(12) United States Patent
Pouillot et al.

(10) Patent No.: US 10,918,680 B2
(45) Date of Patent: Feb. 16, 2021

(54) PHAGE THERAPY OF E COLI INFECTIONS

(71) Applicant: PHERECYDES PHARMA, Romainville (FR)

(72) Inventors: Flavie Pouillot, Paris (FR); Hélène Blois, Paris (FR)

(73) Assignee: PHERECYDES PHARMA, Romainville (FR)

( * ) Notice: Subject to any disclaimer, the term of this patent is extended or adjusted under 35 U.S.C. 154(b) by 0 days.

(21) Appl. No.: 15/110,769

(22) PCT Filed: Jan. 9, 2015

(86) PCT No.: PCT/EP2015/050355
§ 371 (c)(1),
(2) Date: Jul. 11, 2016

(87) PCT Pub. No.: WO2015/104388
PCT Pub. Date: Jul. 16, 2015

(65) Prior Publication Data
US 2017/0000831 A1    Jan. 5, 2017

(30) Foreign Application Priority Data
Jan. 10, 2014    (EP) .................................... 14305041

(51) Int. Cl.
*C12N 7/00* (2006.01)
*A61K 35/76* (2015.01)
(Continued)

(52) U.S. Cl.
CPC .............. *A61K 35/76* (2013.01); *A01N 63/00* (2013.01); *C07K 14/005* (2013.01); *C12N 7/00* (2013.01); *C12Q 1/18* (2013.01); *G01N 33/56916* (2013.01); *C12N 2795/00021* (2013.01); *C12N 2795/00022* (2013.01);
(Continued)

(58) Field of Classification Search
None
See application file for complete search history.

(56) References Cited

U.S. PATENT DOCUMENTS

| 10,077,431 B2 | 9/2018 | Pouillot et al. |
| 2017/0319637 A1 | 11/2017 | Pouillot et al. |
| 2019/0002840 A1 | 1/2019 | Pouillot et al. |

FOREIGN PATENT DOCUMENTS

| CN | 1699560 | 11/2005 |
| CN | 101724607 | 6/2010 |

(Continued)

OTHER PUBLICATIONS

Baker et al., Protein Structure Predication and Structural Genomics, Science (2001) vol. 294, No. 5540, pp. 93-96 (Year: 2001).*

(Continued)

*Primary Examiner* — Michelle S Horning
(74) *Attorney, Agent, or Firm* — Saliwanchik, Lloyd & Eisenschenk

(57) ABSTRACT

The present invention relates to bacteriophage therapy. More particularly, the present invention relates to novel bacteriophages having a high specificity against *Escherichia coli* strains, their manufacture, components thereof, compositions comprising the same and the uses thereof in phage therapy.

14 Claims, 4 Drawing Sheets

Specification includes a Sequence Listing.

(51) Int. Cl.

| | |
|---|---|
| G01N 33/569 | (2006.01) |
| C07K 14/005 | (2006.01) |
| A01N 63/00 | (2020.01) |
| C12Q 1/18 | (2006.01) |

(52) U.S. Cl.
CPC .............. C12N 2795/00031 (2013.01); C12N 2795/00032 (2013.01); C12N 2795/00071 (2013.01); C12N 2795/10121 (2013.01); C12N 2795/10122 (2013.01); C12N 2795/10131 (2013.01); C12N 2795/10132 (2013.01); C12N 2795/10171 (2013.01); C12N 2795/10221 (2013.01); C12N 2795/10222 (2013.01); C12N 2795/10231 (2013.01); C12N 2795/10232 (2013.01); C12N 2795/10271 (2013.01); G01N 2333/245 (2013.01); G01N 2800/52 (2013.01)

(56) References Cited

FOREIGN PATENT DOCUMENTS

| | | |
|---|---|---|
| CN | 101220349 | 2/2011 |
| CN | 103289963 | 9/2013 |
| EP | 2465926 | 6/2012 |
| JP | 2013-541333 | 11/2013 |
| WO | WO 02/07742 | 1/2002 |
| WO | WO 2009/075884 | 6/2009 |
| WO | WO 2012/036580 | 3/2012 |

OTHER PUBLICATIONS

Attwood, T. The Babel of Bioinformatics, Science (2000) vol. 290, No. 5491, pp. 471-473 (Year: 2000).*
Drulis-Kawa et al. Learning from bacteriophages—advantages and limitations of phage and phage-encoded protein applications. Curr Protein Pept Sci. Dec. 2012;13(8):699-722. Review. (Year: 2012).*
GenBank: JN986846.1 (Year: 2012).*
GenBank: JX536493.1 (Year: 2012).*
Carter, C.D. et al. "Bacteriophage cocktail significantly reduces *Escherichia coli* O157:H7 contamination of lettuce and beef, but does not protect against recontamination" *Bacteriophage*, Jul. 2012, pp. 178-185, vol. 2, No. 3.
Pouillot, F. et al. "Genetically Engineered Virulent Phage Banks in the Detection and Control of Emergent Pathogenic Bacteria" *Biosecurity and Bioterrorism: Biodefense Strategy, Practice, and Science*, Jun. 1, 2010, pp. 155-169, vol. 8, No. 2.
Stone, R. "Bacteriophage Therapy: Stalin's Forgotten Cure" *Science*, Oct. 25, 2002, pp. 728-731, vol. 298, No. 5594.
Database EMBL [Online] Accession No. M38308, "Bacteriophage T7 RNA polymerase gene, complete cds" Nov. 7, 1990, p. 1, XP-002725532.
Database EMBL [Online] Accession No. AY303349, "Enterobacteria phage RB69, complete genome" Jul. 1, 2003, pp. 1-58, XP-002725574.
Database EMBL [Online] Accession No. AY370674, "Enterobacteria phage K1-5, complete genome" Feb. 3, 2004, pp. 1-12, XP-002725533.
Database EMBL [Online] Accession No. AM084414, "Enterobacteria phage K1F, complete genome" Dec. 5, 2005, pp. 1-13, XP-002725538.
Database EMBL [Online] Accession No. EF056009, "Enterobacteria phage N4, complete genome" Nov. 15, 2006, pp. 1-18, XP-002725539.
Database EMBL [Online] Accession No. EU330206, "Enterobacteria phage phiEco32, complete genome" Jan. 5, 2008, pp. 1-25, XP-002725530.
Database EMBL [Online] Accession No. DQ832317, "*Escherichia coli* bacteriophage rv5, complete sequence" Jun. 30, 2008, pp. 1-42, XP-002725541.
Database EMBL [Online] Accession No. EU734171, "Enterobacteria phage BA14, complete genome" Jul. 2, 2008, pp. 1-13, XP-002725534.
Database EMBL [Online] Accession No. EU734174, "Enterobacteria phage 13a, complete genome" Jul. 2, 2008, pp. 1-14, XP-002725540.
Database EMBL [Online] Accession No. AZU35935, "Bacteriophage F488/08 genomic DNA, SEQ IQ 3" May 10, 2012, pp. 1-30, XP-002725537.
Database EMBL [Online] Accession No. JX128259, "*Escherichia* phage ECML-134, complete genome" Jul. 29, 2012, pp. 1-53, XP-002725536.
Database EMBL [Online] Accession No. JN986844, "Enterobacteria phage vB_EcoP_ACG-C91, complete genome" Nov. 1, 2012, pp. 1-13, XP-002725531.
Written Opinion in International Application No. PCT/EP2015/050355, May 6, 2015, pp. 1-12.
Ceyssens, P.-J. et al. "Comparative analysis of the widespread and conserved PB1-like viruses infecting *Pseudomonas aeruginosa*" *Environmental Microbiology*, 2009, pp. 2874-2883, vol. 11, No. 11.
Alemayehu, D. et al. "Bacteriophages φMR299-2 and φNH-4 Can Eliminate *Pseudomonas aeruginosa* in the Murine Lung and on Cystic Fibrosis Lung Airway Cells" *MBIO*, Mar. 6, 2012, pp. 1-9, vol. 3, No. 2, Article No. e0002912.
Fu, W. et al. "Bacteriophage Cocktail for the Prevention of Biofilm Formation by *Pseudomonas aeruginosa* on Catheters in an In Vitro Model System" *Antimicrobial Agents and Chemotherapy*, Jan. 1, 2010, pp. 397-404, vol. 54, No. 1.
Fukuda, K. et al. "*Pseudomonas aeruginosa* Keratitis in Mice: Effects of Topical Bacteriophage KPP12 Administration" Plos One, Oct. 2012, pp. 1-8, vol. 7, No. 10, Article No. e47742.
Garbe, J. et al. "Characterization of JG024, a pseudomonas aeruginosa PB1-like broad host range phage under simulated infection conditions" *BMC Microbiology*, Nov. 26, 2010, pp. 1-10, vol. 10, No. 1.
Krylov, V. et al. "A Genetic Approach to the Development of New Therapeutic Phages to Fight *Pseudomonas aeruginosa* in Wound Infections" *Viruses*, Dec. 21, 2012, pp. 15-53, vol. 5.
McVay, C.S. et al. "Phage Therapy of *Pseudomonas aeruginosa* Infection in a Mouse Burn Wound Model" *Antimicrobial Agents and Chemotherapy*, Jun. 2007, pp. 1934-1938, vol. 51, No. 6.
Oikonomou, O. et al. "Investigation of carbapenem heteroresistance among different sequence types of *Pseudomonas aeruginosa* clinical isolates reveals further diversity" *J. Med. Microbiology*, May 19, 2011, pp. 1556-1558, vol. 60, No. 10.
Wright, A. et al. "A controlled clinical trial of a therapeutic bacteriophage preparation in chronic otitis due to antibiotic-resistant *Pseudomonas aeruginosa*; a preliminary report of efficacy" *Clin. Otolaryngol.* 2009, pp. 349-357, vol. 34.
Database EMBL [Online] Accession No. FM887021, "Comparative analysis of the widespread and conserved PB1-like viruses infecting Pseudomonas aeruginosa" Dec. 16, 2008, pp. 1-36, XP-002718979.
Database EMBL [Online] Accession No. AM910650, "Analysis of the genome, proteome and transcriptome of Pseudomonas aeruginosa phage LUZ24" Nov. 27, 2007, pp. 1-26, XP-002718980.
Database EMBL [Online] Accession No. JN254801, "Bacteriophages PhiMR299-2 and PhiNH-4 Can Eliminate Pseudomonas aeruginosa in the Murine Lung and on Cystic Fibrosis Lung Airway Cells" Apr. 27, 2012, pp. 1-32, XP-055161973.
Database EMBL [Online] Accession No. EU716414, "Comparative analysis of the widespread and conserved PB1-like viruses infecting Pseudomonas aeruginosa" Jan. 6, 2009, pp. 1-39, XP-002718981.
Database EMBL [Online] Accession No. JN254800, "Bacteriophages PhiMR299-2 and PhiNH-4 Can Eliminate Pseudomonas aeruginosa in the Murine Lung and on Cystic Fibrosis Lung Airway Cells" Mar. 13, 2012, pp. 1-41, XP-002718982.
Database EMBL [Online] Accession No. GU815091, "Characterization of JG024, a pseudomonas aeruginosa PB1-like broad host range phage under simulated infection conditions" Dec. 16, 2010, pp. 1-64, XP-055162017.
Database EMBL [Online] Accession No. KC294142, "Pseudomonas aeruginosa phage PaP4" Jan. 16, 2013, pp. 1-29, XP-002718983.
Database EMBL [Online] Accession No. AB560486, "Pseudomonas aeruginosa Keratitis in Mice: Effects of Topical Bacteriophage KPP12 Administration" Aug. 23, 2012, pp. 1-35, XP-002718984.
Database EMBL [Online] Accession No. FM201282, "Genome and proteome analysis of newly isolated Pseudomonas aeruginosa phages" Aug. 22, 2008, pp. 1-37, XP-002718985.
Written Opinion in International Application No. PCT/EP2014/072905, Jan. 27, 2015, pp. 1-11.

(56) References Cited

OTHER PUBLICATIONS

Wang, I.-N., et al. "HOLINS: The Protein Clocks of Bacteriophage Infections" Annu. Rev. Microbiol. 2000, pp. 799-825 and supplemental pp. 1-6, vol. 54.
Reardon, S. "Phage therapy gets revitalized" *Nature*, Jun. 5, 2014, pp. 15-16, vol. 510.
Database EBI [Online] Accession No. FM897211, "Pseudomonas phage 14-1, complete genome" Dec. 14, 2008, pp. 1-2, XP-002738707.
Database EBI [Online] Accession No. KF856712, "Pseudomonas phage phiIBB-PAA2, complete genome" Dec. 4, 2013, p. 1, XP-002738709.
Database EBI [Online] Accession No. FM201281, "Pseudomonas phage LBL3 complete genome" Aug. 22, 2008, pp. 1-2, XP-002738708.
Written Opinion in International Application No. PCT/EP2015/075949, Jan. 14, 2016, pp. 1-8.
Database GenBank [Online] Accession No. JQ067092, "Pseudomonas phage PaMx42, complete genome" 2012, pp. 1-25.
Cuevas, J. M. et al. "Point Mutation Rate of Bacteriophage φX174" *Genetics*, Oct. 2009, pp. 747-749, vol. 183.
Ofir, G. et al. "Contemporary Phage Biology: From Classic Models to New Insights" *Cell*, Mar. 8, 2018, pp. 1260-1270, vol. 172.
Database Genbank [Online] Accession No. GQ468526.1, "Enterobacteria phage 285P, complete genome" 2010, pp. 1-18.
Database Genbank [Online] Accession No. AY264774.1, "Enterobacteria phage T7, complete genome" 2003, pp. 1-16.
Annex 1, Search Results from corresponding Ep Application No. 15703227.7, Apr. 12, 2018, pp. 1-11.
Annex 2, Search Results from corresponding Ep Application No. 15703227.7, Apr. 12, 2018, pp. 1-26.

* cited by examiner

PHAGE THERAPY OF *E COLI* INFECTIONS

CROSS-REFERENCE TO RELATED APPLICATION

This application is the U.S. national stage application of International Patent Application No. PCT/EP2015/050355, filed Jan. 9, 2015.

The Sequence Listing for this application is labeled "Seq-List.txt" which was created on Jun. 24, 2016 and is 1552 KB. The entire content of the sequence listing is incorporated herein by reference in its entirety.

The present invention relates to novel bacteriophages, compositions comprising the same, their manufacture, and the uses thereof. The invention is particularly adapted for the treatment of an infection in a mammal and for improving a subject condition by modifying the flora in said subject.

BACKGROUND OF THE INVENTION

Bacteriophages (or phages) are small viruses displaying the ability to infect and kill bacteria while they do not affect cells from other organisms. Initially described almost a century ago by William Twort, and independently discovered shortly thereafter by Felix d'Herelle, more than 6000 different bacteriophages have been discovered and described morphologically, including bacterial and archeal viruses. The vast majority of these viruses are tailed while a small proportion are polyhedral, filamentous or pleomorphic. They may be classified according to their morphology, their genetic content (DNA vs. RNA), their specific host, the place where they live (marine virus vs. other habitats), and their life cycle. As intra-cellular parasites of bacterial cells, phages display different life cycles within the bacterial host: lytic, lysogenic, pseudo-lysogenic, and chronic infection (Weinbauer, 2004; Drulis-Kawa, 2012). Lytic phages cause lysis of the host bacterial cell as a normal part of their life cycles. Lysogenic phages (also termed temperate phages) can either replicate by means of the lytic life cycle and cause lysis of the host bacterium, or they can incorporate their DNA into the host bacterial DNA and become noninfectious prophages. Whatever the type of cycle of a phage life, the first step is the attachment to receptors of the bacterial cell wall before phages may enter the bacteria. This specific process influences the spectrum of the possible phage-bacteria interactions.

Bacteriophages are commonly used as research tools to modify bacteria in laboratory experiments.

Because of their target host cell specificity, the use of phages as a therapy to treat acute and chronic infections has been considered, particularly in dermatology, ophthalmology, urology, stomatology, pediatrics, otolaryngology or surgery. This concept of therapeutic use of phages to treat bacterial infection was, however, highly controversial from the very beginning and not widely accepted by the public or medical community. Early studies were widely criticized for lack of appropriate controls and inconsistent results. The lack of reproducibility and many conflicting results obtained in the various published studies led the Council on Pharmacy and Chemistry of the American Medical Association to conclude that the evidence for the therapeutic value of lytic filtrates was for the most part contradictory, unconvincing, and recommended additional research to confirm its purported benefits.

Since the introduction of antibiotics in the 1940s, little attention was paid to this field of therapeutics, especially in the Western world. But the extensive use of antibiotics has led to the widespread emergence and spread of antibiotic-resistant bacteria around the world, causing increasingly serious problems. It has therefore become a major therapeutic challenge to overcome the limited therapeutic options remaining to treat major multi-drug resistant microbes.

In addition, many pathogenic microorganisms reside within bio films, which bio films cause additional problems when designing new anti-microbial agents. In this regard, bacteria growing as a biofilm rather than in single-celled ("planktonic") forms tend to be particularly resistant to anti-microbial agents and to be particularly difficult for the host immune system to render an appropriate response.

*E. coli*, a Gram-negative, short rod-shaped bacterium belonging to the genus *Escherichia* and the family Enterobacteriaceae, shows high diversity and frequency in human or animal microbial flora. It was revealed that while most strains of *E. coli* are non-pathogenic, they can cause opportunistic infections. Furthermore, some *E. coli* strains are highly pathogenic and can cause diverse diseases and sepsis in mammals, including humans. Several reports associate the enterobacterium *Escherichia coli* with skin and soft tissue infections (SSTIs), one of the most common infections in patients of all age groups. In some moderate or severe cases, these infections require hospitalization and parenteral therapy. *E. coli* was notably found to be the causative agent of neonatal omphalitis (Fraser and al, 2006), cellulitis localized to lower or upper limbs (Brzozowski and al, 1997, Corredoira and al, 1994), necrotizing fasciitis (Afifi and al, 2008; Krebs and al, 2001), surgical site infections (Tourmousoglou and al, 2008), infections after burn injuries (Rodgers and al, 2000), and others. A study monitoring SSTIs during a 7-year period and encompassing three continents (Europe, Latin America, and North America) showed *E. coli* to be an important causative agent, since it was the third-most prevalent isolated species. *E. coli* therefore deserve specific and targeting therapy, especially taking into account the dramatic decline in antibiotic susceptibility of pathogenic *E. coli* strains in recent years, their diversity, and their substantial presence in microbial flora.

Furthermore, *E. coli* bacteria are able to form biofilms, contributing to their increased resistance to antibiotics. Such biofilms may comprise more than one type of bacteria supported and surrounded by an excreted extracellular matrix and assist bacteria to colonize various surfaces. Bio films allow bacteria to attach to surfaces and to attain population densities which would otherwise be unsupportable, imparting increased resistance to not only antibiotics but many environmental stresses including toxins such as heavy metals, bleaches and other cleaning agents. It is known that bacteria within biofilms can be 100 to 1000 times more resistant to antibiotics than the same strain of bacteria growing in planktonic forms. Such an increased resistance means that bacteria that are apparently sensitive to antibiotics in a laboratory test may be resistant to therapy in a clinical setting. Even if some are cleared, bio films may provide resistant reservoirs permitting rapid colonization once antibiotics are no longer present. It is therefore obvious that biofilms are major factors in many human diseases. Chemical treatments are unsuited to use against bio films since this is precisely what they have evolved to counter. Physical abrasion does provide a mean to disrupt biofilms. Unfortunately, many surfaces where bio films supports bacterial pathogenesis are poorly suited to rigorous abrasion, i.e. bones, joints, implanted medical devices, etc. For example, the surfaces of wounds or burns are extremely sensitive and delicate. Even where abrasion is both suitable and in routine use, clearing of biofilms is limited. Oral plaque on the surface of teeth is a biofilm and is partially cleared by regular brushing. However, bacteria are maintained on unbrushed surfaces (for example in the gaps between teeth) and can recolonize cleared surfaces both rapidly and effectively. From this, it is clear that existing approaches to clearing bio films are of limited efficacy.

The capability for quick adaptation and their ability to form bio films are the main reasons that identify *E. coli* as opportunistic pathogens. They have acquired the status of hospital pathogens, and may be isolated from clinical samples taken from the wounds, sputum, bladder, urethra, vagina, ears, eyes and respiratory tract. The emergence of resistance to the most powerful new antibiotics in such clinical *E. coli* strains, occurring even during treatment, makes the fight with *E. coli* hospital pathogens a great problem.

Furthermore, it has been reported that the pathological or physiological condition of a subject is influenced by the balance of microorganisms in the flora of the subject. Accordingly, modifying the microbial flora, or modifying said balance, or restoring said balance, by destroying *E. coli* population, is also a valuable approach for improving a subject condition.

Therefore, there is a great need for new antibacterial agents or compositions that can be used to destroy *E. coli* strains, even when organized in bacterial biofilms, suitable for use in human or animal therapy as well as for decontaminating materials.

SUMMARY OF THE INVENTION

The inventors have isolated and characterized new bacteriophages presenting specific lytic activity to *Escherichia coli* (*E. coli*), and which can be used as active agents in pharmaceutical or veterinary preparations, particularly to treat *E. coli* bacterial infections or to modify microbial balance in a subject. The new bacteriophages of the invention exhibit strong lytic activity, high selectivity, and can by combined to induce controlled destruction of a very large spectrum of *E. coli* cells.

An object of the invention is to provide antibacterial compositions comprising at least one, preferably at least two bacteriophages having lytic activity against an *Escherichia coli* strain, said bacteriophages being selected from the bacteriophages having a genome comprising a nucleotide sequence of anyone of SEQ ID NOs: 1 to 15 or a sequence having at least 90% identity thereto.

A further object of the present invention concerns a bacteriophage having lytic activity to an *Escherichia coli* strain, said bacteriophage having a genome comprising a nucleotide sequence selected from anyone of SEQ ID NOs: 1 to 15 or a sequence having at least 90% identity thereto, preferably at least 97% identity thereto. In a specific embodiment, the bacteriophages of the invention exhibit lytic activity to multi drug resistant strains, in particular to an antibiotic resistant pathogenic *E. coli*, such as, preferably Extended-Spectrum Beta-Lactamases (ESBL) strains or verotoxin-producing *E. coli* (VTEC) strains.

Another object of the invention relates to a bacteriophage which is selected from BP539, BP700, BP753, BP814, BP953, BP954, BP970, BP1002, BP1151, BP1155, BP1168, BP1176, BP1197, BP1226, or BP1229, having a genome comprising the nucleotide sequence of SEQ ID NOs: 1 to 15, respectively, and variants thereof, wherein said variants retain a phenotypic characteristic of said bacteriophage, and wherein said bacteriophage and variants thereof have lytic activity against an *E. coli* strain.

Another object of the invention resides in a composition comprising at least one bacteriophage as defined above. In a particular embodiment, the compositions of the invention comprise at least two distinct bacteriophages as defined above, preferably at least three, even more preferably at least four distinct bacteriophages as defined above. A specific composition of the invention comprises a combination of all of bacteriophages BP539, BP700, BP753, BP814, BP953, BP954, BP970, BP1002, BP1151, BP1155, BP1168, BP1176, BP1197, BP1226 and BP1229.

In another aspect, the invention is related to a bacteriophage having lytic activity to a pathogenic *E. coli* strain, wherein the bacteriophage is specific for *E. coli*, active against antibiotic-resistant *E. coli* strains, and has a productive lytic effect below 15.

The invention further concerns an isolated nucleic acid sequence contained in a bacteriophage of the invention, and an isolated polypeptide encoded by said isolated nucleic acid.

Another object of the invention is a composition comprising a polypeptide as defined above.

A further object of the invention is a composition comprising a nucleic acid as defined above.

The compositions of the invention typically further comprise a pharmaceutically or veterinary acceptable excipient or carrier. They may be liquid, semi-liquid, solid or lyophilized.

Another object of the invention relates to a bacteriophage, nucleic acid, polypeptide or composition as defined above, for use in the treatment of an infection in a mammal, for modifying the microbial flora in a mammal, for decontaminating a material and/or for killing an *E. coli* bacterium or for compromising the integrity of a bacterial biofilm.

The invention relates also to the use of one or several lytic bacteriophages to improve a subject condition by modifying the microbial flora in said subject. The microbial flora may be modified by correcting, adapting or restoring a proper balance of microorganisms in said flora.

The invention also relates to a method for treating an infection in a mammal, comprising the administration to said mammal of at least one bacteriophage, nucleic acid, polypeptide or composition as defined above.

The invention also relates to a method for treating a surface or material suspected of being contaminated with an *E. coli* bacterium, comprising applying to said surface or material at least one bacteriophage, nucleic acid, polypeptide or composition as defined above. The surface or material may be a surface of e.g., any device, vessel or laboratory material, cloth, etc.

Another object of the invention relates to a method for predicting or determining efficacy of a bacteriophage therapy in a subject, wherein the method comprises the step of determining in vitro a lytic activity of one or more bacteriophages of the invention to an *E. coli* strain from a sample of said subject, a lytic activity of one or more bacteriophages of the invention to at least one *E. coli* strain from said sample being indicative of an efficient treatment. The method further optionally comprises the step of treating the subject with at least one bacteriophage having a lytic activity to an *E. coli* strain from a sample of said subject.

In another aspect, the invention provides a method for selecting a subject or determining whether a subject is susceptible to benefit from a bacteriophage therapy, wherein the method comprises the step of determining in vitro a lytic activity of one or more bacteriophages of the invention to an *E. coli* strain from a sample of said subject, a lytic activity of one or more said bacteriophages of the invention to at least one *E. coli* strain being indicative of a responder subject.

The invention may be used in any mammal, preferably in human beings, or to treat any material, including laboratory materials or medical devices.

DETAILED DESCRIPTION OF THE INVENTION

Figure 1:
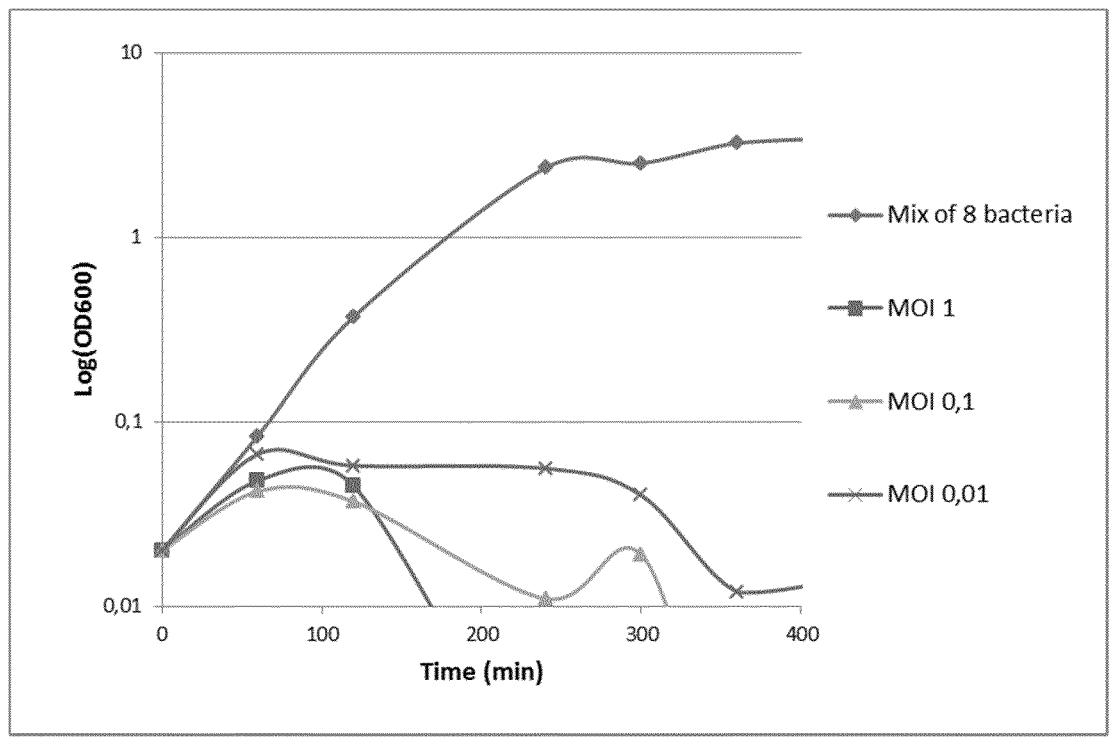
FIG. 1: In vitro efficiency of Bacteriophages of the invention on combinations of *E. coli* strains at various MOIs.

The present invention relates to novel bacteriophages, components thereof, compositions comprising the same, their manufacture, and the uses thereof as antibacterial agents, particularly for the treatment of an infection in a mammal and for improving a subject condition by modifying the microbial flora in said subject.

Definitions

To facilitate understanding of the invention, a number of terms are defined below.

As used herein, the term "bacteriophage" or "phage" refers to a functional phage particle comprising a nucleic acid genome packaged in a proteinaceous envelope or capsid. The term also refers to portions of the bacteriophage, including, e.g., a head portion, or an assembly of phage components, which provide substantially the same functional activity.

The term "phenotypic characteristic" designates more preferably the morphology and/or host-range of a bacteriophage. Methods for phenotyping bacteriophages are well known per se in the part and include, for example, determining bacterial host range and/or activity against the biofilm produced by certain bacterial strains.

The term "lytic activity" as used in the invention designates the property of a bacteriophage to cause lysis of a bacterial cell. The lytic activity of a bacteriophage can be tested on *E. coli* strains according to techniques known per se in the art (see also experimental section).

The term "variant" of a reference bacteriophage designates bacteriophages having variation(s) in the genomic sequence and/or polypeptide(s) encoded thereby as compared to said reference bacteriophage, while retaining the same phenotypic characteristic as the reference bacteriophage. Variants typically comprise e.g., silent mutations, conservative mutations, minor deletions, and/or minor replications of genetic material, and retain phenotypic characteristics of the reference bacteriophage. In a preferred embodiment, the variant of the invention retain any observable characteristic or property that is dependent upon the genome of the bacteriophage of the invention, i.e. phenotypic characteristics of said bacteriophage and/or lytic activity against the *E. coli* strains. Preferred variants have less than 5% nucleic acid variation as compared to the genome of the reference bacteriophage, even more preferably less than 4%, more preferably less than 2%. Alternatively, or in combination, variants have preferably less than 5% amino acid variation in a coded polypeptide sequence as compared to a polypeptide of the reference bacteriophage.

The term "% identity" in relation to nucleic acid sequences designates the level of identity or homology between said sequences and may be determined by techniques known per se in the art. Typically, the % identity between two nucleic acid sequences is determined by means of computer programs such as GAP provided in the GCG program package (Program Manual for the Wisconsin Package, Version 8, August 1996, Genetics Computer Group, 575 Science Drive, Madison, Wis., USA 53711) (Needleman, S. B. and Wunsch, C. D., (1970), Journal of Molecular Biology, 48, 443-453). With settings adjusted to e.g., DNA sequences (particularly: GAP creation penalty of 5.0 and GAP extension penalty of 0.3), nucleic acid molecules may be aligned to each other using the Pileup alignment software available as part of the GCG program package.

The term "fragment" of a nucleic acid designates typically a fragment having at least 10 consecutive nucleotides of said nucleic acid, more preferably at least 15, 20, 25, 30, 35, 40, 50 or more consecutive nucleotides of said nucleic acid.

The term "fragment" of a polypeptide designates typically a fragment having at least 5 consecutive amino acids of said polypeptide, more preferably at least 10, 15, 20, 30, 40, 50 or more consecutive amino acids of said polypeptide.

The term "ESBL *E. coli* strain" refers to antibiotic-resistant *E. coli*, more specifically to Extended-Spectrum Beta-Lactamases-producing *E. coli* strains.

The term "VTEC" refers to another type of antibiotic-resistant *E. coli* strains, more specifically to verotoxin-producing *E. coli* strains.

The term "specific" or "specificity" in relation to a bacteriophage refers to the type of host that said bacteriophage is able to infect. Specificity is usually mediated by the tail fibers of bacteriophages, that are involved in the interaction with receptors expressed on cells. A bacteriophage "specific" for *E. coli* more preferably designates a bacteriophage which can infect one or several *E. coli* strains and which cannot infect non-*E. coli* bacteria under physiological conditions.

As used herein, the term "polypeptide" refers to polypeptides of any size, including small peptides of e.g., from 5 to 20 amino acids, longer polypeptides, proteins or fragments thereof.

The term "PLE" or "Productive Lytic Effect" designates the ratio between burst size and productive lytic time of a given bacteriophage. Burst size and productive lytic time are parameters defining phage-host interaction and correspond, respectively, to the mean yield of bacteriophage particles produced by infection of one bacterium by one phage, and to the time taken by a free bacteriophage to lyse a bacterial cell.

In the context of the present specification, the term "isolated bacteriophage" should be considered to mean material removed from its original environment in which it naturally occurs. In relation to a bacteriophage, the term designates, particularly a phage that is e.g., cultivated, purified and/or cultured separately from the environment in which it is naturally located. In relation to a nucleic acid or polypeptide, the term "isolated" designates e.g., a nucleic acid molecule or polypeptide which is separated from at least some of the components of its natural environment such as, e.g., a protein, lipid, and/or nucleic acid.

The terms "pharmaceutically or veterinary acceptable" as used herein refers to any material (e.g., carrier, excipient or vehicle) that is compatible for use in a mammalian subject. Such includes physiologically acceptable solutions or vehicles that are harmless or do not cause any significant specific or non-specific immune reaction to an organism or do not abrogate the biological activity of the active compound. For formulation of the composition into a liquid preparation, saline, sterile water, Ringer's solution, buffered physiological saline, albumin infusion solution, dextrose solution, maltodextrin solution, glycerol, ethanol, and mixtures thereof may be used as a pharmaceutically or veterinary acceptable excipient or carrier. If necessary, other conventional additives such as thickeners, diluents, buffers, preservatives, surface active agents, antioxidants and bacteriostatic agents may be added. Further, diluents, dispersants, surfactants, binders and lubricants may be additionally added to the composition to prepare injectable formulations such as aqueous solutions, suspensions, and emulsions, oral formulations such as pills, capsules, granules, or tablets, or powdered formulations.

As used herein, "PFU" means plaque forming unit, as it is well defined in the art. Lytic bacteriophages lyse the host cell, causing a zone of clearing (or plaque) on a culture plate. Theoretically, each plaque is formed by one phage and the number of plaques multiplied by the dilution factor is equal to the total number of phages in a test preparation.

The term "treatment" or "therapy" designates both a curative treatment and/or a prophylactic treatment of a disease. A curative treatment is defined as a treatment resulting in cure or a treatment alleviating, improving and/or eliminating, reducing and/or stabilizing the symptoms of a disease or the suffering that it causes directly or indirectly. A prophylactic treatment comprises both a treatment resulting in the prevention of a disease and a treatment reducing and/or delaying the incidence of a disease or the risk of its occurrence.

The term "mammal" includes human subjects as well as non-human mammals such as pets (e.g., dogs, cats), horses, ruminants, sheep, goats, pigs, etc.

The term "biofilm" as used herein designates to be a heterogeneous bacterial formation growing on various surfaces; preferably a bacterial community growing embedded in an exopolysaccharide matrix adhered onto solid biological or non-biological surfaces.

The term "compromise" as used herein refers to any alteration of the integrity. By compromising a bacterial bio film, it is understood a penetration of the bio film by bacteriophage, an infection of bio film-associated bacteria and/or a lysis thereof and/or a partial or an entire clearing of the biofilm (i.e. by stopping colonization and/or disrupting bio films).

The term "sample", as used herein, means any sample containing cells. Examples of such samples include fluids such as blood, plasma, saliva, or urine as well as biopsies, organs, tissues or cell samples. The sample may be treated prior to its use.

As used herein, the term "subject" or "patient" refers to an animal, preferably to a mammal, even more preferably to a human, including adult and child. However, the term "subject" also encompasses non-human animals, in particular mammals such as dogs, cats, horses, cows, pigs, sheep and non-human primates, among others.

The term "efficacy" of treatment or "response" to a bacteriophage therapy as used herein refers to a treatment which results in a decrease in the number of *E. coli* strains in a subject after bacteriophage treatment when compared to the number of *E. coli* strains before treatment. A "good responder" subject refers to a subject who shows or will show a clinically significant recovery when treated with a bacteriophage therapy.

The term "Cocktail" or composition of bacteriophages designates a combination of two or more different bacteriophages. The bacteriophages in a cocktail/composition are preferably formulated together, i.e., in a same vessel or packaging, although they may be used as kits of parts wherein the (or some of the) bacteriophages are formulated or packaged separately and combined when used or administered.

DESCRIPTION OF EMBODIMENTS

The present invention is related to novel bacteriophage therapies. More particularly, the present invention relates to novel bacteriophages having a high specificity against *Escherichia coli* strains, their manufacture, components thereof, compositions comprising the same and the uses thereof in phage therapy.

Bacteriophages:

In a first aspect, the invention discloses the isolation and characterization of novel bacteriophages that are specific for *E. coli* strains and present, either alone or in combination(s), remarkable host range spectrum of lytic activity. These bacteriophages have been selected from environmental samples, isolated, and characterized. As indicated, the bacteriophages are, individually and in combination(s), active against *E. coli* strains. They are remarkable effective against pathogenic *E. coli* strains, such as antibiotic-resistant *E. coli* strains. Furthermore, bacteriophages of the invention have a remarkable productive lytic effect ("PLE") below 15, more preferably below 10 and still more preferably between 0.1 and 10. Furthermore, the bacteriophages of the invention are specific for *E. coli* strains, i.e., they do not causes lysis of non-*E. coli* bacteria. As will be illustrated further, the invention shows that these bacteriophages can be combined and formulated in conditions suitable for use as pharmaceutical or veterinary agents to exhibit targeted and very potent antibacterial effect against a controlled spectrum of *E. coli* strains.

More specifically, the following bacteriophages have been selected and characterized. Their corresponding nucleic acid sequences are also indicated.

TABLE 1

| SEQ ID number | Bacteriophage |
| --- | --- |
| SEQ ID NO: 1 | BP539 |
| SEQ ID NO: 2 | BP700 |
| SEQ ID NO: 3 | BP753 |
| SEQ ID NO: 4 | BP814 |
| SEQ ID NO: 5 | BP953 |
| SEQ ID NO: 6 | BP954 |
| SEQ ID NO: 7 | BP970 |
| SEQ ID NO: 8 | BP1002 |
| SEQ ID NO: 9 | BP1151 |
| SEQ ID NO: 10 | BP1155 |
| SEQ ID NO: 11 | BP1168 |
| SEQ ID NO: 12 | BP1176 |
| SEQ ID NO: 13 | BP1197 |

TABLE 1-continued

| SEQ ID number | Bacteriophage |
|---|---|
| SEQ ID NO: 14 | BP1226 |
| SEQ ID NO: 15 | BP1229 |

The lytic profile of these bacteriophages has been determined on a broad number of *E. coli* strains. These bacteriophages have been selected for their potency and combination potential, as disclosed in the following table. In this table, the lytic effect of the bacteriophages on reference and pathogen-resistant strains are presented, to confirm the high lytic potential.

TABLE 2

| Phage EC | 539 | 700 | 753 | 814 | 953 | 954 | 970 | 1002 | 1151 | 1155 | 1168 | 1176 | 1197 | 1226 | 1229 | 15 phages |
|---|---|---|---|---|---|---|---|---|---|---|---|---|---|---|---|---|
| 1 K12/DH5 | + | | | + | | +* | | + | + | + | + | +* | + | +* | | + |
| 2 ECOR1 | | | | + | + | | | | | | | | | | | + |
| 3 ECOR2 | | | | | + | | +/− | + | | | + | +/− | +/− | + | | + |
| 4 ECOR4 | | | | | + | | | | | | + | | | | | + |
| 5 ECOR5 | | | | | + | + | | | | | | | | | | + |
| 6 ECOR10 | | | + | | | +/− | | | | | | | | | | + |
| 7 ECOR13 | | | | + | + | | | + | +/− | +/− | + | + | + | +/− | | + |
| 8 ECOR15 | + | | | | + | +/− | + | + | + | + | + | | | + | | + |
| 9 ECOR24 | | | | + | | +/− | + | | | | + | | | | | + |
| 10 ECOR28 | | | | + | | + | | | + | + | +/− | + | +/− | +/− | | + |
| 11 ECOR35 | + | | | +* | + | +/− | | + | +/− | | | | | | | + |
| 12 ECOR38 | + | | | + | + | +/− | | | | | | | | | | + |
| 13 ECOR40 | + | | | + | + | +/− | | | | | | | | | | + |
| 14 ECOR46 | | + | + | + | | + | + | + | | | + | | + | | | + |
| 15 ECOR48 | | + | | | +/− | + | | | | | + | +/− | + | | | + |
| 16 ECOR50 | | + | + | | | +/− | +/− | +/− | | | +/− | | +/− | | | + |
| 17 ECOR54 | +* | | | | + | + | + | + | | | + | | + | | | + |
| 18 ECOR55 | | +* | +* | +* | + | | + | + | + | | | | + | | | + |
| 19 ECOR56 | | +* | | + | +* | +* | | | +/− | | | | | | | + |
| 20 ECOR59 | | | | + | + | +/− | +* | +* | +/− | | + | +* | + | | | + |
| 21 ECOR60 | + | | | + | + | +/− | | | | +* | + | +/− | | | | + |
| 22 ECOR62 | + | | | + | | + | | | | | | | | | | + |
| 23 ECOR64 | + | + | + | | + | + | | | | | | | | | | + |
| 24 ECOR71 | + | | | | | +/− | + | +/− | | | + | | | | | + |
| 25 ECOR72 | | | + | + | | | +/− | | | +/− | +/− | +/− | +/− | | | + |

Boxes with an asterisk ("*") are examples of producing *E. coli* strains.

As can be seen from table 2, the phages have individually very strong lytic power, and combinations (or cocktails) of these bacteriophages may be produced that are able to kill all of the tested *E. coli* strains, thereby producing broad spectrum antibacterial compositions.

As an illustration, a cocktail of all 15 phages of the invention is able to effectively kill all bacteria listed in Table 2.

Moreover, the specificity of the bacteriophages has been tested on many non-*E. coli* strains. More particularly, the experimental section demonstrates that the bacteriophages of the invention have no lytic effect on bacteria selected from *Pseudomonas aeruginosa, Acinebacter baumanii, Enterobacter aerogenes, Enterobacter ashuriae, Enterobacter cloacae, Klebsiella pneumonia, Porteus mirabilis, Staphylococus aureus, Stenotrophomonas maltophila* and/or *Serratia marcescens*.

A particular object of the invention thus resides in a bacteriophage having lytic activity to an *E. coli* strain and having a genome comprising a nucleotide sequence selected from anyone of SEQ ID NOs: 1 to 15 or a sequence having at least 97% identity thereto, preferably at least 98% or 99% identity thereto.

A particular object of the invention thus resides in a bacteriophage having lytic activity to an *E. coli* strain and having a genome having or consisting of a nucleotide sequence selected from anyone of SEQ ID NOs: 1 to 15.

The bacteriophages of the invention can be prepared by standard culture, isolation and purification methods. For example, *E. coli* producing bacteria are cultured, infected by a sample of a bacteriophage, and then treated to remove bacterial cells and debris. The enriched bacteriophage solution can be plated in a medium, for example agar medium, with embedded susceptible host strains of *E. coli* to obtain plaques. Then, single plaque can be picked out for subsequent bacteriophage purification and amplification. One or more cycles of selective amplification of bacteriophages of the invention may be performed, for example by mixing bacteriophages with the competent *E. coli*, followed by addition of a growth medium and incubation at selected test growing conditions. Following centrifugation, the cleared amplified supernatant is filtered through filter and subjected to another cycle of selective amplification or tested for presence of lytic activity. The titer of phage in a suspension and the visualization of plaque morphology of bacteriophages of the invention can be estimated by known methods, for example by plaque counting. Additionally, processing bacteriophages of the invention in various form (liquid, lyophilized, etc.) for short-, long-, freeze- or any other kind of storage can be carried out by any suitable method as it is well-known in the art (see Clark, 1962).

The activity of the bacteriophages of the invention can be assessed by methods well-known in the art, such as plaque assay also known as double agar method, based on the growing of bacteriophage with potential host bacteria and followed by assessing their ability to kill the host bacterial cell. In the plaque assay method, the bacteriophage induces lysis of target *E. coli* strains after a period of incubation in soft agar medium, resulting in zones of clearing on the plate known as plaques. In a preferred aspect, the bacteriophages of the invention exhibit, either alone or in combination, lytic activity to a pathogenic *E. coli* strain, including to an antibiotic-resistant *E. coli* strain, such as an ESBL *E. coli* strain. Furthermore, variants of these bacteriophages retaining a phenotypic (e.g., specificity and lytic activity) of these bacteriophages can be produced and/or isolated by techniques known per se in the art.

In a particular embodiment, the invention is related to BP539 bacteriophage, or any variant thereof. BP539 bacteriophage, or any variant thereof, can be produced or expanded in e.g., *E. coli* strain ECOR54. BP539, or any variant thereof, is specific and has lytic activity against K12/DH5, ECOR15, ECOR35, ECOR38, ECOR40, ECOR54, ECOR62, ECOR64 and/or ECOR71 strains. BP539 comprises a genome comprising a sequence as set forth in SEQ ID NO: 1 or having at least 80% identity, more preferably at least 85% identity, and still more preferably 90%, 92%, 94%, 95%, 96%, 97%, 98% or 99% identity to SEQ ID NO: 1. It is also provided an isolated nucleic acid sequence from BP539 bacteriophage, or variant thereof. The invention also encompasses isolated polypeptides encoded by BP539 bacteriophage, or variant thereof, or encoded by an isolated nucleic acid sequence from a BP539 bacteriophage of the invention. BP539 bacteriophage of the invention is also characterized by a PLE below 15, more preferably below 10 and still more preferably of around 0.1.

In another particular embodiment, the invention is related to BP700 bacteriophage, or any variant thereof. BP700 bacteriophage, or any variant thereof, can be produced or expanded in e.g., *E. coli* strain ECOR55. BP700, or any variant thereof, is specific and has lytic activity against ECOR46, ECOR55, ECOR60 and/or ECOR64 strains. BP700 comprises a genome comprising a sequence as set forth in SEQ ID NO: 2 or having at least 80% identity, more preferably at least 85% identity, and still more preferably 90%, 92%, 94%, 95%, 96%, 97%, 98% or 99% identity to SEQ ID NO: 2. It is also provided an isolated nucleic acid sequence from BP700 bacteriophage, or variant thereof. The invention also encompasses isolated polypeptides encoded by BP700 bacteriophage, or variant thereof, or encoded by an isolated nucleic acid sequence from BP700 bacteriophage of the invention.

BP700 bacteriophage of the invention is also characterized by a PLE below 15, more preferably below 10 and still more preferably of around 2.

In still another aspect, the invention is related to BP753 bacteriophage, or any variant thereof. BP753 bacteriophage, or any variant thereof, can be produced or expanded in e.g., *E. coli* strain ECOR56. BP753, or any variant thereof, is specific and has lytic activity against ECOR10, ECOR48 and/or ECOR56 strains. BP753 comprises a genome comprising a sequence as set forth in SEQ ID NO: 3 or having at least 80% identity, more preferably at least 85% identity, and still more preferably 90%, 92%, 94%, 95%, 96%, 97%, 98% or 99% identity to SEQ ID NO: 3. It is also provided an isolated nucleic acid sequence from BP753 bacteriophage, or variant thereof. The invention also encompasses isolated polypeptides encoded by BP753 bacteriophage, or variant thereof, or encoded by an isolated nucleic acid sequence from BP753 bacteriophage of the invention.

BP753 bacteriophage of the invention is also characterized by a PLE below 15, more preferably below 10 and still more preferably of around 2.

In another aspect, the invention is related to BP814 bacteriophage, or any variant thereof. BP814 bacteriophage, or any variant thereof, can be produced or expanded in e.g., *E. coli* strain ECOR55. BP814, or any variant thereof, is specific and has lytic activity against ECOR46, ECOR50, ECOR55 and/or ECOR64 strains. BP814 comprises a genome comprising a sequence as set forth in SEQ ID NO: 4 or having at least 80% identity, more preferably at least 85% identity, and still more preferably 90%, 92%, 94%, 95%, 96%, 97%, 98% or 99% identity to SEQ ID NO: 4. It is also provided an isolated nucleic acid sequence from BP814 bacteriophage, or variant thereof. The invention also encompasses isolated polypeptides encoded by BP814 bacteriophage, or variant thereof, or encoded by an isolated nucleic acid sequence from BP814 bacteriophage of the invention.

BP814 bacteriophage of the invention is also characterized by a PLE below 15, more preferably below 10 and still more preferably of around 0.3.

In another particular embodiment, the invention is related to BP953 bacteriophage, or any variant thereof. BP953 bacteriophage, or any variant thereof, can be produced or expanded in e.g., *E. coli* strain ECOR55. BP953, or any variant thereof, is specific and has lytic activity against K12/DH5, ECOR1, ECOR46, ECOR50, ECOR54, ECOR55, ECOR59 and/or ECOR60 strains. BP953 comprises a genome comprising a sequence as set forth in SEQ ID NO: 5 or having at least 80% identity, more preferably at least 85% identity, and still more preferably 90%, 92%, 94%, 95%, 96%, 97%, 98% or 99% identity to SEQ ID NO: 5. It is also provided an isolated nucleic acid sequence from BP953 bacteriophage, or variant thereof. The invention also encompasses isolated polypeptides encoded by BP953 bacteriophage, or variant thereof, or encoded by an isolated nucleic acid sequence from BP953 bacteriophage of the invention. BP953 bacteriophage of the invention is also characterized by a PLE below 15, more preferably below 10 and still more preferably of around 3.

In another particular embodiment, the invention is related to BP954 bacteriophage, or any variant thereof. BP954 bacteriophage, or any variant thereof, can be produced or expanded in e.g., *E. coli* strain ECOR35. BP954, or any variant thereof, is specific and has lytic activity against ECOR24, ECOR35, ECOR38, ECOR40, ECOR46 and/or ECOR62 strains. BP954 comprises a genome comprising a sequence as set forth in SEQ ID NO: 6 or having at least 80% identity, more preferably at least 85% identity, and still more preferably 90%, 92%, 94%, 95%, 96%, 97%, 98% or 99% identity to SEQ ID NO: 6. It is also provided an isolated nucleic acid sequence from BP954 bacteriophage, or variant thereof. The invention also encompasses isolated polypeptides encoded by BP954 bacteriophage, or variant thereof, or encoded by an isolated nucleic acid sequence from BP954 bacteriophage of the invention.

BP954 bacteriophage of the invention is also characterized by a PLE below 15, more preferably below 10 and still more preferably of around 3.

In still another aspect, the invention is related to BP970 bacteriophage, or any variant thereof. BP970 bacteriophage, or any variant thereof, can be produced or expanded in e.g., *E. coli* strain K12/DH5. BP970, or any variant thereof, is specific and has lytic activity against K12/DH5, ECOR1, ECOR2, ECOR5, ECOR10, ECOR13, ECOR15, ECOR28 and/or ECOR72 strains. BP970 comprises a genome comprising a sequence as set forth in SEQ ID NO: 7 or having at least 80% identity, more preferably at least 85% identity, and still more preferably 90%, 92%, 94%, 95%, 96%, 97%, 98% or 99% identity to SEQ ID NO: 7. It is also provided an isolated nucleic acid sequence from BP970 bacteriophage, or variant thereof. The invention also encompasses isolated polypeptides encoded by BP970 bacteriophage, or variant thereof, or encoded by an isolated nucleic acid sequence from BP970 bacteriophage of the invention.

BP970 bacteriophage of the invention is also characterized by a PLE below 15, more preferably below 10 and still more preferably of around 5.

In another particular embodiment, the invention is related to BP1002 bacteriophage, or any variant thereof. BP1002 bacteriophage, or any variant thereof, can be produced or expanded in e.g., *E. coli* strain ECOR56. BP1002, or any variant thereof, is specific and has lytic activity against ECOR15, ECOR24, ECOR35, ECOR38, ECOR40, ECOR48, ECOR54, ECOR55, ECOR56, ECOR59, ECOR60 and/or ECOR64 strains. BP1002 comprises a genome comprising a sequence as set forth in SEQ ID NO: 8 or having at least 80% identity, more preferably at least 85% identity, and still more preferably 90%, 92%, 94%, 95%, 96%, 97%, 98% or 99% identity to SEQ ID NO: 8. It is also provided an isolated nucleic acid sequence from BP1002 bacteriophage, or variant thereof. The invention also encompasses isolated polypeptides encoded by BP1002 bacteriophage, or variant thereof, or encoded by an isolated nucleic acid sequence from BP1002 bacteriophage of the invention.

BP1002 bacteriophage of the invention is also characterized by a PLE below 15, more preferably below 10 and still more preferably of around 5.

In another particular embodiment, the invention is related to BP1151 bacteriophage, or any variant thereof. BP1151 bacteriophage, or any variant thereof, can be produced or expanded in e.g., *E. coli* strain ECOR56. BP1151, or any variant thereof, is specific and has lytic activity against K12/DH5, ECOR2, ECOR13, ECOR15, ECOR24, ECOR35, ECOR38, ECOR40, ECOR46, ECOR48, ECOR50, ECOR54, ECOR56, ECOR59, ECOR60, ECOR62, ECOR64 and/or ECOR71 strains. BP1151 comprises a genome comprising a sequence as set forth in SEQ ID NO: 9 or having at least 80% identity, more preferably at least 85% identity, and still more preferably 90%, 92%, 94%, 95%, 96%, 97%, 98% or 99% identity to SEQ ID NO: 9. It is also provided an isolated nucleic acid sequence from BP1151 bacteriophage, or variant thereof. The invention also encompasses isolated polypeptides encoded by BP1151 bacteriophage, or variant thereof, or encoded by an isolated nucleic acid sequence from BP1151 bacteriophage of the invention.

BP1151 bacteriophage of the invention is also characterized by a PLE below 15, more preferably below 10 and still more preferably of around 10.

In another aspect, the invention is related to BP1155 bacteriophage, or any variant thereof. BP1155 bacteriophage, or any variant thereof, can be produced or expanded in e.g., *E. coli* strain ECOR59. BP1155, or any variant thereof, is specific and has lytic activity against K12/DH5, ECOR2, ECOR13, ECOR15, ECOR28, ECOR46, ECOR50, ECOR54, ECOR55, ECOR59 and/or ECOR71 strains. BP1155 comprises a genome comprising a sequence as set forth in SEQ ID NO: 10 or having at least 80% identity, more preferably at least 85% identity, and still more preferably 90%, 92%, 94%, 95%, 96%, 97%, 98% or 99% identity to SEQ ID NO: 10. It is also provided an isolated nucleic acid sequence from BP1155 bacteriophage, or variant thereof. The invention also encompasses isolated polypeptides encoded by BP1155 bacteriophage, or variant thereof, or encoded by an isolated nucleic acid sequence from BP1155 bacteriophage of the invention.

BP1155 bacteriophage of the invention is also characterized by a PLE below 15, more preferably below 10 and still more preferably of around 0.5.

In still another aspect, the invention is related to BP1168 bacteriophage, or any variant thereof. BP1168 bacteriophage, or any variant thereof, can be produced or expanded in e.g., *E. coli* strain ECOR59. BP1168, or any variant thereof, is specific and has lytic activity against K12/DH5, ECOR13, ECOR15, ECOR28, ECOR35, ECOR46, ECOR50, ECOR54, ECOR55, ECOR59, ECOR71 and/or ECOR72 strains. BP1168 comprises a genome comprising a sequence as set forth in SEQ ID NO: 11 or having at least 80% identity, more preferably at least 85% identity, and still more preferably 90%, 92%, 94%, 95%, 96%, 97%, 98% or 99% identity to SEQ ID NO: 11. It is also provided an isolated nucleic acid sequence from BP1168 bacteriophage, or variant thereof. The invention also encompasses isolated polypeptides encoded by BP1168 bacteriophage, or variant thereof, or encoded by an isolated nucleic acid sequence from BP1168 bacteriophage of the invention.

BP1168 bacteriophage of the invention is also characterized by a PLE below 15, more preferably below 10 and still more preferably of around 0.8.

In another aspect, the invention is related to BP1176 bacteriophage, or any variant thereof. BP1176 bacteriophage, or any variant thereof, can be produced or expanded in e.g., *E. coli* strain ECOR60. BP1176, or any variant thereof, is specific and has lytic activity against K12/DH5, ECOR2, ECOR4, ECOR13, ECOR15, ECOR24, ECOR28, ECOR35, ECOR55, ECOR56, ECOR59 and/or ECOR60 strains. BP1176 comprises a genome comprising a sequence as set forth in SEQ ID NO: 12 or having at least 80% identity, more preferably at least 85% identity, and still more preferably 90%, 92%, 94%, 95%, 96%, 97%, 98% or 99% identity to SEQ ID NO: 12. It is also provided an isolated nucleic acid sequence from BP1176 bacteriophage, or variant thereof. The invention also encompasses isolated polypeptides encoded by BP1176 bacteriophage, or variant thereof, or encoded by an isolated nucleic acid sequence from BP1176 bacteriophage of the invention.

BP1176 bacteriophage of the invention is also characterized by a PLE below 15, more preferably below 10 and still more preferably of around 4.

In still another aspect, the invention is related to BP1197 bacteriophage, or any variant thereof. BP1197 bacteriophage, or any variant thereof, can be produced or expanded in e.g., *E. coli* strain K12/DH5. BP1197, or any variant thereof, is specific and has lytic activity against K12/DH5, ECOR2, ECOR13, ECOR15, ECOR28, ECOR46, ECOR48, ECOR50, ECOR54, ECOR59, ECOR60, ECOR71 and/or ECOR72 strains. BP1197 comprises a genome comprising a sequence as set forth in SEQ ID NO: 13 or having at least 80% identity, more preferably at least 85% identity, and still more preferably 90%, 92%, 94%, 95%, 96%, 97%, 98% or 99% identity to SEQ ID NO: 13. It is also provided an isolated nucleic acid sequence from BP1197 bacteriophage, or variant thereof. The invention also encompasses isolated polypeptides encoded by BP1197 bacteriophage, or variant thereof, or encoded by an isolated nucleic acid sequence from BP1197 bacteriophage of the invention.

BP1197 bacteriophage of the invention is also characterized by a PLE below 15, more preferably below 10 and still more preferably of around 1.

In an aspect, the invention is related to BP1226 bacteriophage, or any variant thereof. BP1226 bacteriophage, or any variant thereof, can be produced or expanded in e.g., *E. coli* strain ECOR59. BP1226, or any variant thereof, is specific and has lytic activity against K12/DH5, ECOR2, ECOR13, ECOR28, ECOR48, ECOR59, ECOR60 and/or ECOR72 strains. BP1226 comprises a genome comprising a sequence as set forth in SEQ ID NO: 14 or having at least 80% identity, more preferably at least 85% identity, and still more preferably 90%, 92%, 94%, 95%, 96%, 97%, 98% or 99% identity to SEQ ID NO: 14. It is also provided an isolated nucleic acid sequence from BP1226 bacteriophage, or variant thereof. The invention also encompasses isolated polypeptides encoded by BP1226 bacteriophage, or variant thereof, or encoded by an isolated nucleic acid sequence from BP1226 bacteriophage of the invention.

BP1226 bacteriophage of the invention is also characterized by a PLE below 15, more preferably below 10 and still more preferably of around 5.

In another particular embodiment, the invention is related to BP1229 bacteriophage, or any variant thereof. BP1229 bacteriophage, or any variant thereof, can be produced or expanded in e.g., *E. coli* strain K12/DH5. BP1229, or any variant thereof, is specific and has lytic activity against K12/DH5, ECOR2, ECOR13, ECOR15, ECOR28, ECOR46, ECOR48, ECOR50, ECOR54, ECOR55, ECOR59, and/or ECOR72 strains. BP1229 comprises a genome comprising a sequence as set forth in SEQ ID NO: 15 or having at least 80% identity, more preferably at least 85% identity, and still more preferably 90%, 92%, 94%, 95%, 96%, 97%, 98% or 99% identity to SEQ ID NO: 15. It is also provided an isolated nucleic acid sequence from BP1229 bacteriophage, or variant thereof. The invention also encompasses isolated polypeptides encoded by BP1229 bacteriophage, or variant thereof, or encoded by an isolated nucleic acid sequence from BP1229 bacteriophage of the invention.

BP1229 bacteriophage of the invention is also characterized by a PLE below 15, more preferably below 10 and still more preferably of around 6.

Nucleic Acids and Polypeptides

The invention also relates to a nucleic acid contained in a bacteriophage of the invention, or any fragment of such a nucleic acid. The term fragment designates, more preferably, a fragment containing (or consisting of) an open reading frame. The nucleic acid may be DNA or RNA, single- or double-stranded.

The nucleic acid can be isolated from the deposited bacteriophages, or produced using recombinant DNA technology (e.g., polymerase chain reaction (PCR) amplification, cloning), enzymatic or chemical synthesis, or combinations thereof, according to general techniques known per se in the art. Also included are homologous sequences and fragments thereof including, but not limited to, natural allelic variants and modified nucleic acid sequences in which nucleotides have been inserted, deleted, substituted, and/or inverted.

In a particular embodiment, the invention relates to a nucleic acid comprising a sequence selected from anyone of SEQ ID NOs: 1-15, or a sequence having at least 90%, 92%, 94%, 95%, 96%, 97%, 98%, 99% or more sequence identity to anyone of SEQ ID NOs: 1-15.

In another particular embodiment, the invention relates to a nucleic acid comprising the sequence of a fragment of a sequence selected from anyone of SEQ ID NOs: 1-15, or a fragment of a sequence having at least 90%, 92%, 94%, 95%, 96%, 97%, 98%, 99% or more sequence identity to anyone of SEQ ID NOs: 1-15, said fragment comprising an open reading frame or a regulatory element such as a promoter.

In a particular embodiment, the invention relates to a nucleic acid having or consisting of a sequence selected from anyone of SEQ ID NOs: 1-15, or a sequence having at least 90%, 92%, 94%, 95%, 96%, 97%, 98%, 99% or more sequence identity to anyone of SEQ ID NOs: 1-15.

The nucleic acid of the invention can be in free form, or cloned in a vector.

In a further aspect, the invention also relates to an isolated polypeptide encoded by a nucleic acid sequence selected from SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14 and SEQ ID NO: 15. The polypeptides may be produced by techniques known per se in the art such as synthesis, recombinant technology, or combinations thereof. The polypeptides may be isolated or purified, and used as antibacterial agents or as reagents for in vitro analyses.

Compositions of the Invention:

One aspect of the invention relates to compositions comprising at least one bacteriophage as described above, more preferably at least 2 or more and, optionally, a pharmaceutically or veterinary acceptable excipient. As described, the bacteriophages of the invention have very potent lytic activity against *E. coli* strains. Combinations of these bacteriophages may be produced to expand the host spectrum and produce highly effective antibacterial compositions.

More particularly, the invention relates to an antibacterial composition comprising at least two bacteriophages having lytic activity against an *E. coli* strain, said at least two bacteriophages being selected from the bacteriophages having a genome comprising a nucleotide sequence of anyone of SEQ ID NOs: 1 to 15 or a sequence having at least 90% identity thereto, preferably at least 91%, 92%, 93%, 94%, 95%, 96%, 97%, 98% or 99% identity thereto.

In a preferred embodiment, the compositions of the invention comprise at least three, even more preferably at least four distinct bacteriophages selected from the bacteriophages having a genome comprising a nucleotide sequence of anyone of SEQ ID NOs: 1 to 15 or a sequence having at least 90% identity thereto, preferably at least 91%, 92%, 93%, 94%, 95%, 96%, 97%, 98% or 99% identity thereto. Compositions of the invention may comprise at least 5, 6, 7, 8, 9, 10, 11, 11, 12, 13, 14 or all of the 15 distinct bacteriophages as disclosed above.

One aspect of the invention is related to a composition at least one bacteriophage selected from BP539, BP700, BP753, BP814, BP953, BP954, BP970, BP1002, BP1151, BP1155, BP1168, BP1176, BP1197, BP1226, and/or BP1229, and variants thereof.

The invention also concerns a composition comprising at least two distinct bacteriophages selected from BP539, BP700, BP753, BP814, BP953, BP954, BP970, BP1002, BP1151, BP1155, BP1168, BP1176, BP1197, BP1226, and/or BP1229, and variants thereof.

Preferably, a composition of the invention comprises at least three distinct bacteriophages, more preferably at least four distinct bacteriophages, still more preferably at least five distinct bacteriophages, still more preferably at least six distinct bacteriophages, more preferably at least seven distinct bacteriophages, more preferably at least eight distinct bacteriophages, still more preferably at least nine distinct bacteriophages and still more preferably at least ten distinct bacteriophages selected from BP539, BP700, BP753, BP814, BP953, BP954, BP970, BP1002, BP1151, BP1155, BP1168, BP1176, BP1197, BP1226, and/or BP1229, and variants thereof.

In a particular embodiment, a composition of the invention comprises BP539 in combination with at least one further bacteriophage selected from BP700, BP753, BP814, BP1151, BP1176, and BP1168.

In another particular embodiment, a composition of the invention comprises BP1002 in combination with at least one further bacteriophage selected from BP1151, BP1155, BP1168, BP1176 and BP1197.

In another particular embodiment, the composition comprises BP1155 in combination with at least one further bacteriophage selected from BP1168, BP1197, BP1226, BP1229 and BP1176.

In another preferred embodiment, the composition comprises BP1151 in combination with at least one further bacteriophage selected from BP1176, BP953, BP970, BP700 and BP1002.

In another preferred embodiment, the composition comprises BP953 and/or BP1168 and/or BP1176, optionally in further combination with at least one further bacteriophage of the invention.

The invention particularly relates to a composition comprising a combination of bacteriophages BP953+BP1168. Such a composition could kill 100% tested hemorrhagic *E. coli* strains and nearly 70% of the 25 *E. coli* bacteria of Table 2 (see Example 3.1).

The invention also relates to a composition comprising a combination of bacteriophages BP953+BP1168+BP1229. Such a composition can kill *E. coli* bacteria type O157, O144 and O104, including hemorrhagic strains (see Example 3.2).

The invention also relates to a composition comprising a combination of bacteriophages BP953+BP1151+BP1155+BP1176. Such a composition could kill 80% of all tested *E. coli* bacteria isolated from hospitals (see Example 3.3).

The invention also relates to a composition comprising a combination of bacteriophages BP700+BP953+BP970+BP1002+BP1176. Such a composition could kill 100% of tested ST131-type *E. coli* bacteria, at least 80% of tested BLSE *E. coli* bacteria and at least 93% of tested BMR-type *E. coli* bacteria (see Example 3.4).

The invention also relates to a composition comprising a combination of bacteriophages BP1002+BP1151+BP1155+BP1168+BP1176. Such a composition can kill 100% of tested meningitis-causing *E. coli* bacteria (see Example 3.5).

The invention also relates to a composition comprising a combination of bacteriophages BP539+BP700+BP753+BP814+BP1151+BP1176+BP1168. Such a composition could kill nearly 96% of the 24 *E. coli* bacteria of the ECOR collection of Table 2 (see Example 3.6).

The invention also relates to a composition comprising a combination of all of the bacteriophages BP539, BP700, BP753, BP814, BP953, BP954, BP970, BP1002, BP1151, BP1155, BP1168, BP1176, BP1197, BP1226, and/or BP1229, or variants thereof. Such a composition could kill 100% of the 25 *E. coli* bacteria of Table 2 (see Example 3.7).

Specific examples of compositions of the invention comprise:

a bacteriophage having a genome comprising a nucleotide sequence of SEQ ID NO: 5 or a sequence having at least 90% identity thereto, and a bacteriophage having a genome comprising a nucleotide sequence of SEQ ID NO: 11 or a sequence having at least 90% identity thereto;

a bacteriophage having a genome comprising a nucleotide sequence of SEQ ID NO: 5 or a sequence having at least 90% identity thereto, and a bacteriophage having a genome comprising a nucleotide sequence of SEQ ID NO: 11 or a sequence having at least 90% identity thereto, and a bacteriophage having a genome comprising a nucleotide sequence of SEQ ID NO: 15 or a sequence having at least 90% identity thereto;

a bacteriophage having a genome comprising a nucleotide sequence of SEQ ID NO: 5 or a sequence having at least 90% identity thereto, and a bacteriophage having a genome comprising a nucleotide sequence of SEQ ID NO: 9 or a sequence having at least 90% identity thereto, and a bacteriophage having a genome comprising a nucleotide sequence of SEQ ID NO: 10 or a sequence having at least 90% identity thereto, and a bacteriophage having a genome comprising a nucleotide sequence of SEQ ID NO: 12 or a sequence having at least 90% identity thereto;

a bacteriophage having a genome comprising a nucleotide sequence of SEQ ID NO: 2 or a sequence having at least 90% identity thereto, and a bacteriophage having a genome comprising a nucleotide sequence of SEQ ID NO: 5 or a sequence having at least 90% identity thereto, and a bacteriophage having a genome comprising a nucleotide sequence of SEQ ID NO: 7 or a sequence having at least 90% identity thereto, and a bacteriophage having a genome comprising a nucleotide sequence of SEQ ID NO: 8 or a sequence having at least 90% identity thereto, and a bacteriophage having a genome comprising a nucleotide sequence of SEQ ID NO: 12 or a sequence having at least 90% identity thereto;

a bacteriophage having a genome comprising a nucleotide sequence of SEQ ID NO: 8 or a sequence having at least 90% identity thereto, and a bacteriophage having a genome comprising a nucleotide sequence of SEQ ID NO: 9 or a sequence having at least 90% identity thereto, and a bacteriophage having a genome comprising a nucleotide sequence of SEQ ID NO: 10 or a sequence having at least 90% identity thereto, and a bacteriophage having a genome comprising a nucleotide sequence of SEQ ID NO: 11 or a sequence having at least 90% identity thereto, and a bacteriophage having a genome comprising a nucleotide sequence of SEQ ID NO: 12 or a sequence having at least 90% identity thereto; or a bacteriophage having a genome comprising a nucleotide sequence of SEQ ID NO: 1 or a sequence having at least 90% identity thereto, and a bacteriophage having a genome comprising a nucleotide sequence of SEQ ID NO: 2 or a sequence having at least 90% identity thereto, and a bacteriophage having a genome comprising a nucleotide sequence of SEQ ID NO: 3 or a sequence having at least 90% identity thereto, and a bacteriophage having a genome comprising a nucleotide sequence of SEQ ID NO: 4 or a sequence having at least 90% identity thereto, and a bacteriophage having a genome comprising a nucleotide sequence of SEQ ID NO: 9 or a sequence having at least 90% identity thereto, and a bacteriophage having a genome comprising a nucleotide sequence of SEQ ID NO: 12 or a sequence having at least 90% identity thereto, and a bacteriophage having a genome comprising a nucleotide sequence of SEQ ID NO: 11 or a sequence having at least 90% identity thereto.

A specific embodiment of the invention relates to a composition comprising:

a bacteriophages having a genome comprising a nucleotide sequence of SEQ ID NO: 1 or a sequence having at least 90% identity thereto;

a bacteriophages having a genome comprising a nucleotide sequence of SEQ ID NO: 2 or a sequence having at least 90% identity thereto;

a bacteriophages having a genome comprising a nucleotide sequence of SEQ ID NO: 3 or a sequence having at least 90% identity thereto;

a bacteriophages having a genome comprising a nucleotide sequence of SEQ ID NO: 4 or a sequence having at least 90% identity thereto;
a bacteriophages having a genome comprising a nucleotide sequence of SEQ ID NO: 5 or a sequence having at least 90% identity thereto;
a bacteriophages having a genome comprising a nucleotide sequence of SEQ ID NO: 6 or a sequence having at least 90% identity thereto;
a bacteriophages having a genome comprising a nucleotide sequence of SEQ ID NO: 7 or a sequence having at least 90% identity thereto;
a bacteriophages having a genome comprising a nucleotide sequence of SEQ ID NO: 8 or a sequence having at least 90% identity thereto;
a bacteriophages having a genome comprising a nucleotide sequence of SEQ ID NO: 9 or a sequence having at least 90% identity thereto;
a bacteriophages having a genome comprising a nucleotide sequence of SEQ ID NO: 10 or a sequence having at least 90% identity thereto;
a bacteriophages having a genome comprising a nucleotide sequence of SEQ ID NO: 11 or a sequence having at least 90% identity thereto;
a bacteriophages having a genome comprising a nucleotide sequence of SEQ ID NO: 12 or a sequence having at least 90% identity thereto;
a bacteriophages having a genome comprising a nucleotide sequence of SEQ ID NO: 13 or a sequence having at least 90% identity thereto;
a bacteriophages having a genome comprising a nucleotide sequence of SEQ ID NO: 14 or a sequence having at least 90% identity thereto; and
a bacteriophages having a genome comprising a nucleotide sequence of SEQ ID NO: 15 or a sequence having at least 90% identity thereto.

The compositions of the invention exert lytic activity towards bacterial pathogen *E. coli*. The compositions of the invention may further comprise additional antibacterial agents, particularly other bacteriophages having distinct host specificity.

Preferred compositions of the invention are lytic against antibiotic-resistant *E. coli* strains.

Further preferred compositions of the invention are lytic against more that 90% of all bacterial strains of the EcoR collection, a reference collection of *E. coli* strains found in nature.

The antibacterial compositions of the invention may be in various forms, such as liquid, semi-liquid, solid or lyophilized formulations.

It is desired in an aspect of the invention that the composition comprises between $10^{e2}$ and $10^{e12}$ PFU of at least one bacteriophage of the invention, preferably between $10^{e5}$ and $10^{e10}$ PFU. When the antibacterial composition comprises several bacteriophages as defined above, it is preferred that the composition comprises between $10^{e2}$ and $10^{e12}$ PFU of each present bacteriophage of the invention.

The compositions of the invention may comprise any effective amount of the selected bacteriophage(s). Preferably, they comprise between $10^{e2}$ and $10^{e12}$ PFU of each of said bacteriophages, preferably between $10^{e5}$ and $10^{e10}$ PFU. The relative amounts of each type of bacteriophage in a composition of the invention may be adjusted by a skilled artisan. Typically, when the antibacterial composition comprises several (n) distinct bacteriophages as defined above, the total relative amount % A of each bacteriophage in the composition is more preferably % $A=(100/n_1) \times V$, wherein $n_1$ represents the number of distinct types of bacteriophages and V is a variability factor comprised between 0.2 and 5. Most preferably, V is comprised between 0.3 and 3, even more preferably between 0.5 and 2, generally between 0.8 and 1.5. In a typical embodiment, when the antibacterial composition comprises several bacteriophages as defined above, it is preferred that the composition comprises between $10^{e2}$ and $10^{e12}$ PFU of each present bacteriophage of the invention. Preferably, each type of bacteriophage is present in a composition of the invention in approximately equal relative amounts.

The compositions of the invention preferably comprise a suitable diluent or carrier, such as a pharmaceutically or veterinary acceptable excipient or carrier. Compositions according to the present invention may include any excipient or carrier, such as thickeners, diluents, buffers, preservatives, surface active agents and the like, in addition to the bacteriophage(s) of choice. Such includes physiologically acceptable solutions or vehicles that are harmless or do not cause any significant specific or non-specific immune reaction to an organism or do not abrogate the biological activity of the bacteriophage. For liquid formulation, saline, sterile water, Ringer's solution, buffered physiological saline, albumin infusion solution, dextrose solution, maltodextrin solution, glycerol, ethanol, and mixtures thereof may be used as a pharmaceutically or veterinary acceptable excipient or carrier. If appropriate, other conventional additives such as thickeners, diluents, buffers, preservatives, surface active agents, antioxidants and bacteriostatic agents may be added. Further, diluents, dispersants, surfactants, binders and lubricants may be additionally added to the composition to prepare injectable formulations such as aqueous solutions, suspensions, and emulsions, oral formulations such as pills, capsules, granules, or tablets, or powdered formulations. Formulations for topical administration may include, band aids, dressings, patches, films, ointments, lotions, creams, gels, drops, suppositories, sprays, nebulizer, tampons, sanitary towels, liquids and powders. Formulations for decontamination or for medical use may also include aerosols or sprays.

The compositions of the invention may be used in the medical field, including the human or veterinary medical areas, for e.g. the treatment of an infection in a mammal or for improving a subject's condition.

The compositions may be used to kill *E. coli* bacteria in an organism, for treating an infection. The composition may also be used for improving the condition of a mammal by modifying the microbial flora in said mammal. In particular, the compositions of the invention can specifically remove *E. coli* strains on the skin or mucous membranes of a mammal, thus modifying its microbial flora and restoring a proper balance.

In a particular embodiment, the invention also relates to a method for treating an infection in a mammal comprising the administration to said mammal of a composition or bacteriophage or nucleic acid or polypeptide as defined above.

In a particular embodiment the method comprises administering at least one, preferably at least two, even more preferably at least three bacteriophages selected from BP539, BP700, BP753, BP814, BP953, BP954, BP970, BP1002, BP1151, BP1155, BP1168, BP1176, BP1197, BP1226, and/or BP1229, or variants thereof.

The invention also relates to the use of a composition, bacteriophage, nucleic acid or polypeptide as described for the manufacture of a medicament for treating an infection in a mammal, or for restoring microbial flora in said mammal.

The compositions or agents of the invention may be administered by any convenient route, including intravenous, oral, transdermal, subcutaneous, mucosal, intramuscular, intrapulmonary, intranasal, parenteral, rectal, vaginal and topical. In a preferred embodiment, the bacteriophages or compositions are administered by topical route, e.g., by application on the skin of a subject. The compositions may be administered directly or indirectly, e.g., via a support. In this regard, the compositions may, for example, be applied or sprayed to the afflicted area. Compositions of the invention can also be administered by oral or parenteral routes. The dosage suitable for applying, spraying, or administrating the compositions of the present invention can be adjusted by the skilled person depending on a variety of factors including formulation, mode of administration, age, weight, sex, condition, diet of the mammal being treated at the time of administration, route of administration and reaction sensitivity. A physician having ordinary skills in the art can readily determine and prescribe the effective amount of the composition required.

The dosing can also be adjusted by the skilled person so that a lytic activity against antibiotic-resistant $E.$ $coli$ strains is obtained. An efficient dose to obtain a lytic activity in vivo typically includes a concentration of at least $10^{e2}$ PFU/ml, preferably from about $10^{e2}$ to $10^{e12}$ PFU/ml, depending on the administration route. Administration may be performed only once or, if needed, repeated.

The compositions of the invention may be administered to treat $E.$ $coli$ infections, typically respiratory tract, urinary tract, burns, wounds, ear, skin and soft tissue, gastrointestinal or post-surgical infections.

As shown in the experimental section, the bacteriophages and compositions of the invention are able to selectively kill $E.$ $coli$ bacteria in vitro or in vivo. The compositions can destroy mixtures of different $E.$ $coli$ bacteria, even in vivo, even at low dosage. Furthermore, the compositions of the invention are effective in killing bacteria embedded in biofilms, which is particularly important for pathogenic bacteria. Also, the compositions and bacteriophages of the invention are strictly unable to affect mammalian cells, and are, therefore, specific and devoid of side effects in vivo.

The invention also relates to the use of a composition, bacteriophage, nucleic acid or polypeptide of the invention for decontaminating a material. Due to their potent antibacterial effect, and to their ability to even compromise the integrity of a bacterial biofilm, the compositions of the invention can be used as decontaminating agent, to eliminate or at least cause a reduction in bacterial numbers on a material. Such methods may be applied for the treatment of a variety of biological or non-biological surfaces in both medical and non-medical contexts, including solid materials or devices such as, for example, contact lenses, surfaces of devices to be implanted into the body, pipes, ducts, laboratory vessels, textiles, etc.

Diagnostic/Predictive Tests of the Invention:

The invention also concerns a method for predicting or determining the efficacy of a bacteriophage therapy in a subject, wherein the method comprises a step of determining a lytic activity of one or more bacteriophage selected from BP539, BP700, BP753, BP814, BP953, BP954, BP970, BP1002, BP1151, BP1155, BP1168, BP1176, BP1197, BP1226, and/or BP1229 to an $E.$ $coli$ strain from a sample from said subject, such a lytic activity being indicative of an efficient treatment. In a preferred aspect, the method further optionally comprises a step of treating said subject by one or more bacteriophages having a lytic activity to an $E.$ $coli$ strain from a sample of said subject.

In another aspect, the invention provides a method for selecting a subject or determining whether a subject is susceptible to benefit from a bacteriophage therapy, wherein the method comprises the step of determining a lytic activity of one or more bacteriophage selected from BP539, BP700, BP753, BP814, BP953, BP954, BP970, BP1002, BP1151, BP1155, BP1168, BP1176, BP1197, BP1226, and/or BP1229 to an $E.$ $coli$ strain from a sample of said subject, a lytic activity of one or more bacteriophage of the invention to at least one $E.$ $coli$ strain indicating a responder subject.

Another object of the invention relates to a method for predicting the response of a subject to a bacteriophage therapy, wherein the method comprises the step of determining a lytic activity of one or more bacteriophage selected from BP539, BP700, BP753, BP814, BP953, BP954, BP970, BP1002, BP1151, BP1155, BP1168, BP1176, BP1197, BP1226, and/or BP1229 to an $E.$ $coli$ strain from a sample of said subject, a lytic activity of one or more bacteriophage of the invention to at least one $E.$ $coli$ strain being indicative of a good response to said therapy.

Further aspects and advantages of the invention will be disclosed in the following experimental section, which is illustrative only.

EXAMPLES

Materials and Methods

Phage Isolation and Preparation

MDR $E.$ $coli$ bacteria were used for isolating and enriching each virulent bacteriophage from environmental water. Environmental samples and overnight culture of bacteria in Luria Bertani (LB) were mixed and incubated at 37° C. for 24 h with shaking to enrich specific bacteriophages. At the end of incubation, drops of chloroform were added to the culture. The culture was spun down at 11,000 g for 5 minutes to remove bacterial cells and debris. The supernatant was subjected to 0.2 μm filter to remove the residual bacterial cells. The enriched phage solution was plated on LB agar medium with $E.$ $coli$ embedded. Plaques formed on the plates after 24 h incubation at 37° C. Single plaque was picked out for subsequent phage purification and amplification. The phage was then stored at 4° C. in a suspension in LB broth or physiological saline.

The titer of phage in a suspension was estimated by plaque counting (Postic, 1961). 10-fold dilutions of a suspension were delivered on a dried lawn of the propagating strain. The plates were read after overnight incubation. The plaque-counting method also permitted visualization of plaque morphology.

Host Range Determination.

The host ranges of bacteriophages were determined among a collection of 26 $E.$ $coli$ from the ECOR collection. $10^9$ bacterial cells were mixed with melted agar and this mixture was poured on solid agar to make double layer agar plates. After solidification, isolated bacteriophage stock solutions were spotted on each plate with different bacterium strain. After allowing 20 min for the spots to be absorbed, the plates were inverted and incubated for 24 h at 37° C. before the degree of lysis was recorded.

Electron Microscopy.

Electron micrographs of each phage were taken with a transmission electron microscope.

Sequencing, Analysis and Annotation of Phage Genomes.

To isolate phage DNA, phages were propagated as described above. Phage DNA was isolated by extraction with phenol:chloroform:isoamyl alcohol (25:24:1, VAT), ethanol precipitation and resolution in water. Whole genome sequencing was done and the BLAST algorithm was used to determine the similarity to described genes in the National Center for Biotechnology Information [NCBI] database. The genomes were scanned for potential open reading frames (ORFs).

Example 1

Bacteriophage-Host Characteristics and Kinetics

One-step growth experiments were carried out according to the previous descriptions to determine first the productive lytic time, adsorption rate, and then the phage burst size. To determine the adsorption rate samples were taken at different time intervals to analyze the free phage particles in the solutions. For productive time and phage burst size determination, E. coli bacteria were mixed with phages solutions and phages were allowed to adsorb for 15 min. The mixture was subjected to centrifugation immediately at 5000 rpm for 10 min to remove free phage particles. The pellet was resuspended in 5 fresh LB medium and the culture was continuously incubated at 37° C. Samples were taken at 3 min intervals and phage titre was determined. These results permitted to calculate the number of phages produced per bacteria (burst size), the productive time and the productive lytic effect (PLE), as shown in table 3 below.

TABLE 3

| Phage | Productive lytic time (min) | Adsorption rate (ml-1 min-1) | BURST SIZE (PFU per bacterium) | PLE (PFU per bacterium per min) |
|---|---|---|---|---|
| 539 | 70 | 9.83E−09 | 9 | 0.13 |
| 700 | 15 | 1.04E−08 | 32 | 2.13 |
| 753 | 60 | 3.00E−08 | 119 | 1.98 |
| 814 | 30 | 2.30E−08 | 9 | 0.30 |
| 953 | 20 | 2.05E−08 | 66 | 3.30 |
| 954 | 20 | 2.01E−08 | 66 | 3.30 |
| 970 | 10 | 2.24E−08 | 46 | 4.60 |
| 1002 | 10 | 8.40E−09 | 49 | 4.90 |

TABLE 3-continued

| Phage | Productive lytic time (min) | Adsorption rate (ml-1 min-1) | BURST SIZE (PFU per bacterium) | PLE (PFU per bacterium per min) |
|---|---|---|---|---|
| 1151 | 10 | 2.10E−08 | 99 | 9.90 |
| 1155 | 15 | 1.21E−08 | 7 | 0.47 |
| 1168 | 10 | 8.70E−09 | 8 | 0.80 |
| 1176 | 60 | 1.56E−08 | 232 | 3.87 |
| 1197 | 45 | 6.60E−09 | 49 | 1.09 |
| 1226 | 30 | 8.87E−09 | 149 | 4.97 |
| 1229 | 55 | 6.55E−09 | 332 | 6.04 |

These results show that all phages have potent viral production capacity and absorption rates. Most phages have a PLE below 5, which demonstrates a remarkable profile. Phage 539 is particularly effective in this regard. In addition, the different PLE and adsorption times permit to create cocktails with selected variability.

Example 2

Preparation of a Cocktail Composition

The following cocktail compositions are constituted, each comprising between $10^{-9}$ and $10^{-11}$ pfu of each bacteriophage:

TABLE 4

| Cocktail | Phages |
|---|---|
| I | BP953 + BP1168 |
| II | BP953 + BP1168 + BP1229 |
| III | BP953 + BP1151 + BP1155 + BP1176 |
| IV | BP700 + BP953 + BP970 + BP1002 + BP1176 |
| V | BP1002 + BP1151 + BP1155 + BP1168 + BP1176 |
| VI | BP539 + BP700 + BP753 + BP814 + BP1151 + BP1176 + BP1168 |

The following additional two cocktail compositions comprising all of the various phages are constituted, covering the most important diversity of E. coli species.

TABLE 5A cocktail composition A:

| Phage | BP539 | BP 700 | BP 753 | BP 814 | BP 953 | BP 954 | BP970 | BP1002 |
|---|---|---|---|---|---|---|---|---|
| Titer | $2.72^{E+09}$ | $8.00^{E+09}$ | $2.27^{E+08}$ | $5.89^{E+07}$ | $4.53^{E+10}$ | $3.00^{E+08}$ | $4.02^{E+08}$ | $9.73^{E+08}$ |

| Phage | BP1151 | BP1155 | BP1168 | BP1176 | BP1197 | BP1226 | B1229 |
|---|---|---|---|---|---|---|---|
| Titer | $1.56^{E+09}$ | $3.00^{E+10}$ | $7.77^{E+09}$ | $1.00^{E+10}$ | $3.91^{E+09}$ | $4.44^{E+06}$ | $9.11^{E+09}$ |

TABLE 5B cocktail composition B:

| Phage | BP539 | BP 700 | BP 753 | BP 814 | BP 953 | BP 954 | BP970 | BP1002 |
|---|---|---|---|---|---|---|---|---|
| Titer | $8.85^{E+08}$ | $7.89^{E+08}$ | $7.26^{E+07}$ | $3.04^{E+08}$ | $9.47^{E+08}$ | $3.89^{E+08}$ | $9.56^{E+07}$ | $2.09^{E+09}$ |

| Phage | BP1151 | BP1155 | BP1168 | BP1176 | BP1197 | BP1226 | B1229 |
|---|---|---|---|---|---|---|---|
| Titer | $7.35^{E+08}$ | $2.57^{E+09}$ | $3.01^{E+09}$ | $1.77^{E+09}$ | $1.03^{E+10}$ | $2.00^{E+09}$ | $1.56^{E+09}$ |

Example 3

Sensitivity of Bacteria to Bacteriophage Cocktails of the Invention

Various strains of bacteria were tested with a bacteriophage cocktail of the invention at $2.10^9$ bacteriophages/ml. Different bacterial concentrations were plated on the bacteriophage cocktail at $2.10^9$ bacteriophages/ml and incubated 24 h at 37° C.

Cocktails are tested on distinct *E. coli* bacteria listed in table 2 as well as additional *E. coli* bacteria, including meningitis-causing bacteria from R. Debré collection (37 strains), BLSE (5 strains) and ST131 (9 strains) type *E. coli* bacteria, *E. coli* bacteria derived from hospitalized patients (35 strains), and haemorrhagic *E. coli* bacteria of O157, O144 and O104 type (3 strains). The % of bacteria species sensitive to the cocktails are listed in table 6 below:

Example 3.1

Efficacy of Cocktail I

As shown in the following Table 6 below, cocktail I is able to destroy 100% of tested haemorrhagic *E. coli* bacteria.

TABLE 6

|  | BP953 | BP1168 | Cocktail I |
|---|---|---|---|
| O157:133 |  | + | + |
| O144:227 |  | + | + |
| O104:H4 | + |  | + |

Furthermore, cocktail I can also destroy nearly 70% of the 25 *E. coli* bacteria of table 2.

Example 3.2

Efficacy of Cocktail II

As shown in the following Table 7, cocktail II is able to destroy 100% of tested haemorrhagic *E. coli* bacteria.

TABLE 7

|  | BP953 | BP1168 | BP1229 | Cocktail II |
|---|---|---|---|---|
| O157:133 |  | + | + | + |
| O144:227 |  | + | + | + |
| O104:H4 | + |  |  | + |

Furthermore, cocktail II can also destroy 76% of the 25 *E. coli* bacteria of table 2.

Example 3.3

Efficacy of Cocktail III

As shown in the following Table 8, cocktail III is able to destroy at least 80% of tested *E. coli* strains isolated from hospitalized patients.

TABLE 8

|  | BP953 | BP1151 | B1155 | BP1176 | Cocktail III |
|---|---|---|---|---|---|
| NDM-1 |  |  |  | + | + |
| SH1 | + |  |  | + | + |
| SH4 |  | + |  |  | + |
| SH5 |  | + |  | + | + |
| SH7 |  | + |  | +/− | + |
| SH9 |  | + |  | + | + |
| SH11 |  |  |  |  |  |
| SH12 |  |  |  | + | + |
| SH25 |  |  |  |  |  |
| SH76 |  | + | + |  | + |
| SH78 | + |  |  |  | + |
| SH79 |  |  |  |  |  |
| SH80 |  |  |  |  |  |
| SH81 | +/− |  |  |  | + |
| SH84 |  | +/− | +/− |  | + |
| SH86 |  |  | + |  | + |
| SH87 |  | + | + |  | + |
| SH88 | +/− |  |  | + | + |
| SH90 |  | + | +/− | + | + |
| SH92 |  |  |  | + | + |
| SH95 |  | +/− |  | + | + |
| SH96 |  | + |  | + |  |
| SH100 | + | + |  | +/− | + |
| SH102 | + | + |  | + | + |
| SH103 | + |  |  | +/− | + |
| SH104 |  |  |  | + | + |
| SH105 |  | + |  | + | + |
| SH107 |  |  |  |  |  |
| SH112 |  |  |  | + | + |
| SH113 |  | + |  | + | + |
| SH117 |  | +/− |  | + | + |
| SH118 |  |  | + |  | + |
| SH119 |  |  |  |  |  |
| SH120 | + |  |  | + | + |
| SH123 |  |  |  |  |  |

Example 3.4

Efficacy of Cocktail IV

As shown in the following Table 9, cocktail IV is able to destroy ST131 and BLSE-type *E. coli* strains.

TABLE 9

|  | BP700 | BP953 | BP970 | BP1002 | BP1176 | Cocktail IV |
|---|---|---|---|---|---|---|
| ST131 TN03 | + | + | + | + | + | + |
| ST131 RD20873 |  | +/− |  | + | + |  |
| ST131 RD 5530 | + | + | +/− | +/− | + | + |
| ST131 XXF |  |  | +/− | +/− | + | + |
| ST131 XXT | + | + | +/− | + | + | + |
| ST131 6601 | + | + |  | + | + | + |
| ST131 27144 |  |  |  | + | + | + |
| ST131 28678 |  |  |  | +/− | + | + |
| ST131 30151 | + | + | +/− |  | + | + |
| BSE3 | + |  |  | + |  | + |

TABLE 9-continued

|       | BP700 | BP953 | BP970 | BP1002 | BP1176 | Cocktail IV |
|-------|-------|-------|-------|--------|--------|-------------|
| BSE4  |       |       |       | +      | +/−    | +           |
| BSE7  |       |       | +     |        |        | +           |
| BSE9  | +/−   | +     | +/−   |        | +      | +           |
| BSE12 |       |       |       |        |        |             |

Example 3.5

Efficacy of Cocktail V

As shown in the following Table 10, cocktail V was able to destroy 100% meningitis-causing *E. coli* bacteria from R Debré collection.

TABLE 10

|        | BP1002 | BP1151 | BP1155 | BP1168 | BP1176 | BP1197 | Cocktail V |
|--------|--------|--------|--------|--------|--------|--------|------------|
| CFT073 | +/−    | +      |        |        |        |        | +          |
| J96    | +/−    | +/−    |        |        | +      |        | +          |
| 536    | +      | +      | +/−    | +      |        | +      | +          |
| S5     | +      | +      | +      | +      |        | +      | +          |
| S11    | +      | +      | +      | +      |        | +      | +          |
| S12    | +      | +      | +      | +      | +      | +      | +          |
| S13    | +      | +/−    |        |        |        |        | +          |
| S15    |        | +      |        |        | +/−    |        | +          |
| S22    | +      | +      |        |        |        |        | +          |
| S25/C5 | +      | +/−    |        |        |        |        | +          |
| S39    | +      | +      |        |        | +      |        | +          |
| S41    |        | +/−    | +/−    | +      | +      | +      | +          |
| S43    | +      | +/−    |        |        |        |        | +          |
| S49    | +      |        |        | +      | +      |        | +          |
| S51    |        | +      | +      | +      |        | +      | +          |
| S55    | +/−    | +      |        |        | +      |        | +          |
| S63    | +      | +      |        |        |        |        | +          |
| S69    | +      | +/−    | +      | +      |        | +      | +          |
| S88    | +/−    | +/−    | +/−    | +/−    | +/−    | +/−    | +          |
| S97    | +/−    | +      | +/−    | +/−    | +      | +/−    | +          |
| S102   |        | +      | +      |        | +      | +      | +          |
| S104   | +/−    | +      |        | +/−    | +      | +/−    | +          |
| S105   | +/−    | +      |        |        | +      |        | +          |
| S106   | +/−    | +      | +      | +      | +      | +      | +          |
| S113   | +      | +      |        |        | +      |        | +          |
| S120   |        | +/−    |        |        |        |        | +          |
| S123   | +/−    | +      |        |        | +/−    |        | +          |
| S124   |        | +      |        |        | +      |        | +          |
| S130   |        | +/−    |        |        | +      |        | +          |
| S133   | +/−    | +      |        |        |        |        | +          |
| S138   | +      | +/−    |        |        |        |        | +          |
| S149   | +      | +      |        |        | +      |        | +          |
| S176   | +/−    | +/−    |        |        |        |        | +          |
| S182   | +      | +      |        |        | +      |        | +          |
| S191   | +/−    | +      |        |        | +      |        | +          |
| S192   | +      | +      |        |        | +      |        | +          |
| S242   |        | +      |        |        | +      |        | +          |

Example 3.6

Efficacy of Cocktail VI

Cocktail VI is able to destroy nearly 96% of the 24 *E. coli* bacteria of ECOR collection as listed in table 2.

Example 3.7

Efficacy of Cocktails A and B

Cocktails A and B are both able to 100% of the 25 *E. coli* bacteria listed in table 2.

Bacteria were further enumerated and used to the calculation of resistance rate (number of bacteria after incubation/number of bacteria plated). Resistance rates with cocktail A comprising the 15 different types of bacteriophages are shown in the following table 11:

TABLE 11

| Bacteria | Rate (bacteria/ml) |
|----------|--------------------|
| ECOR1    | >1.00E−02          |
| ECOR24   | 2.00E−05           |
| ECOR60   | 4.00E−06           |
| S22      | 1.18E−04           |
| S106     | <1.00E−06          |
| S182     | 2.00E−06           |
| SH5      | 1.00E−06           |

TABLE 11-continued

| Bacteria | Rate (bacteria/ml) |
|---|---|
| SH113 | 1.00E−06 |
| Astrid 9 | <1.00E−06 |
| BSE 3 | 8.50E−05 |
| BSE 7 | 5.00E−06 |
| 0157:133 | 2.63E−04 |
| XXT | 1.74E−04 |

All tested bacteria are sensitive to compositions of the invention.

Example 4

Cocktail Specificity

The cocktail specificity was confirmed by testing on ten bacteria species, including *Pseudomonas aeruginosa, Acinebacter baumanii, Enterobacter aerogenes C, Enterobacter asburiae, Enterobacter cloacae, Klebsiella pneumoniae, Proteus mirabilis, Staphylococus aureus, Stenotrophomonas maltophila, Serratia marcescens*.

Table 12 summarizes lytic activity observed for each bacteriophage used independently or in combination as a cocktail of 15 bacteriophages.

TABLE 12

| Bacterium | Phage EC | E54 539 | E55 700 | E56 753 | E55 814 | E55 953 | E35 954 | DH5 970 | E56 1002 | E56 1151 | E59 1155 | E59 1168 | E60 1176 | DH5 1197 | E59 1226 | DH5 1229 | Cocktail 15 phages |
|---|---|---|---|---|---|---|---|---|---|---|---|---|---|---|---|---|---|
| *E. coli* | SH 213 | +/− | | | | | | +/− | +/− | +/− | + | + | | + | +/− | + | + |
|  | SH 141 | | | | | | | +/− | | | +/− | +/− | | +/− | | +/− | +/− |
| *Pseudomonas aeruginosa* | SH 85 | | | | | | | | | | | | | | | | − |
|  | SH 224 | | | | | | | | | | | | | | | | − |
| *Acinebacter baumanii* | SH 32 | | | | | | | | | | | | | | | | − |
|  | SH 34 | | | | | | | | | | | | | | | | − |
| *Enterobacter aerogenes C* | SH 97 | | | | | | | | | | | | | | | | − |
|  | SH 98 | | | | | | | | | | | | | | | | − |
| *Enterobacter asburiae* | SH 74 | | | | | | | | | | | | | | | | − |
| *Enterobacter cloacae* | SH 111 | | | | | | | | | | | | | | | | − |
|  | SH 121 | | | | | | | | | | | | | | | | − |
| *Klebsiella pneumoniae* | SH 89 | | | | | | | | | | | | | | | | − |
|  | SH 283 | | | | | | | | | | | | | | | | − |
| *Proteus mirabilis* | SH 82 | | | | | | | | | | | | | | | | − |
| *Staphylococus aureus* | SH 14 | | | | | | | | | | | | | | | | − |
|  | SH 129 | | | | | | | | | | | | | | | | − |
| *Stenotrophomonas maltophila* | SH 286 | | | | | | | | | | | | | | | | − |
|  | SH 290 | | | | | | | | | | | | | | | | − |
| *Serratia marcescens* | SH 314 | | | | | | | | | | | | | | | | − |

The above table clearly show that no lytic activity on bacteria other than *E. coli* strain occurred. The bacteriophages and cocktail of the invention are therefore highly specific for *E. coli* strains.

Example 5

Efficiency of Bacteriophages on *E. coli* Strain In Vitro

Several strains of the EcoR collection were chosen to represent the genetic diversity of *E. coli* and various forms of antibiotic resistance. Strains were either sensitive or resistant to one or several antibiotics. They were grown individually or in combination with 2 to 8 strains. The bacteriophage cocktail was added at a MOI of 1 to $10^{e-6}$, i.e. at a dilution ratio (bacteria/phage) of 1 to 1 million.

The results are presented in FIG. 1 and in the following Table 13.

TABLE 13

Efficiency of bacteriophage cocktail obtained in vitro on *E. coli* mixture: at $2.10^{e7}$ cfu/ml and at various dilutions:

| Mix: | MOI 1 | MOI 0.1 | MOI 0.01 | MOI 0.001 | MOI 0.0001 | MOI 0.000001 |
|---|---|---|---|---|---|---|
| 1 bacterium | ++ | ++ | ++ | ++ | + | + |
| 2 bacteria | ++ | ++ | + | +/− | +/− | +/− |
| 3 bacteria | ++ | ++ | + | + | +/− | +/− |
| 4 bacteria | ++ | ++ | ++ | + | +/− | +/− |
| 5 bacteria | ++ | ++ | ++ | + | + | +/− |
| 6 bacteria | ++ | ++ | + | +/− | +/− | +/− |
| 7 bacteria | ++ | ++ | ++ | + | +/− | +/− |
| 8 bacteria | ++ | ++ | ++ | + | +/− | |

The compositions of the invention are able to kill a mixture of 8 distinct strains of *E. coli* bacteria. The cocktail remains efficient against 8 strains at a dilution of 1/1000.

Example 6

Efficiency of Bacteriophages on *E. coli* Strain In Vivo

An isolated SH113 strain, collected on a burned patient in 2011, was used for the following experiments.

SH113 strain is resistant to ampicillin, ticarcillin, cefalotin, cefotaxim, nalidixic acid, norfloxacin, ofloxacin, ciprofloxacin.

SKH1 mouse (or hairless mouse) was used as mouse model of *E. coli* infection.

Modus operandi: (see table 14 below)

Mice were immunodepressed by 3 IP injections of 1.5 mg of cyclophosphamide (Cy), every 2 days from the Day −3 before infection.

Mice were burned on skin by 2 μl of liquid yperite at 30 mg/kg.

Infection two days after the burn by subcutaneous injection of a bacterium suspension in burned site.

TABLE 14

| Day | −3<br>1.5 mg Cy | −2<br>Burn | −1<br>1.5 mg Cy | 0<br>Infection | 1<br>1.5 mg Cy |
|---|---|---|---|---|---|
| Injection route | IP | Yperite | IP | SC $10^7$ cfu | IP |
| PHAGE | | | | SC, IV or IP injection of cocktail (100 µl, i.e. $10^8$ PFU) 6 h post-infection | |

Cocktail compositions were prepared according to example 2 and compresses were soaked with bacteriophages cocktail at $10^{e7}$ phages/ml before applying at Day 0.

Figure 2:
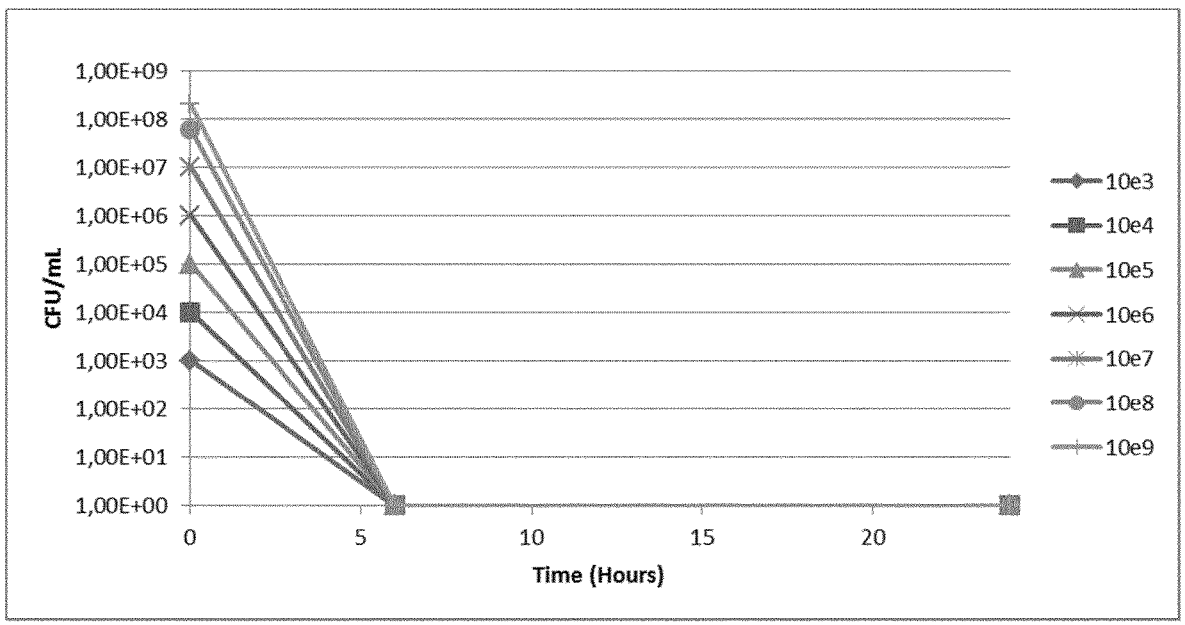
FIG. 2: In vivo efficacy of Bacteriophages of the invention on combinations of *E. coli* strains at various dosages.

Various concentrations of *E. coli* strains were tested with 100 µl of bacteriophage cocktail. As shown on FIG. 2, all *E. coli* strains were killed 6 h post-treatment.

Figure 3:
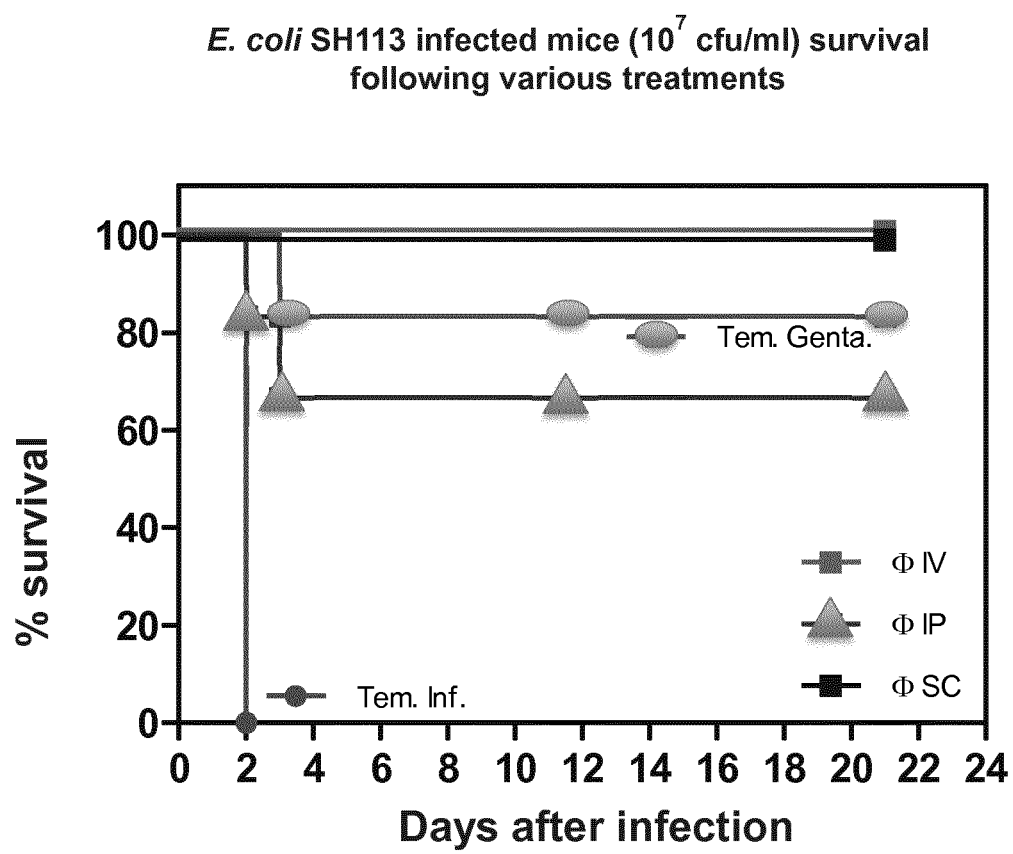
FIG. 3: Efficacy of bacteriophages of the invention on SH113 *E. coli* strain-mediated infection in vivo. Φ IV: intravenous treatment; Φ IP: intraperitoneal treatment; Φ SC: subcutaneous treatment; Temp Inf.: infected untreated control; Tem Genta.: infected gentamicin-treated control.

Upon administration of SH113 *E. coli* strain by subcutaneous injection to SKH1 mice, all mice died in the absence of further treatment. In the mice treated by injection of a bacteriophage cocktail as presented in table 9 above, a remarkable survival rate was observed (see FIG. 3): 100% survival for SKH1 mice treated subcutaneously or intravenously and 65% survival for intraperitoneal route treatment. By comparison, a 80% survival rate was observed for SKH1 mice treated by a double dose of gentamicin antibiotic at Day 0+6 h and during 7 consecutive days, including 2 injections on Day 1.

Figure 4:
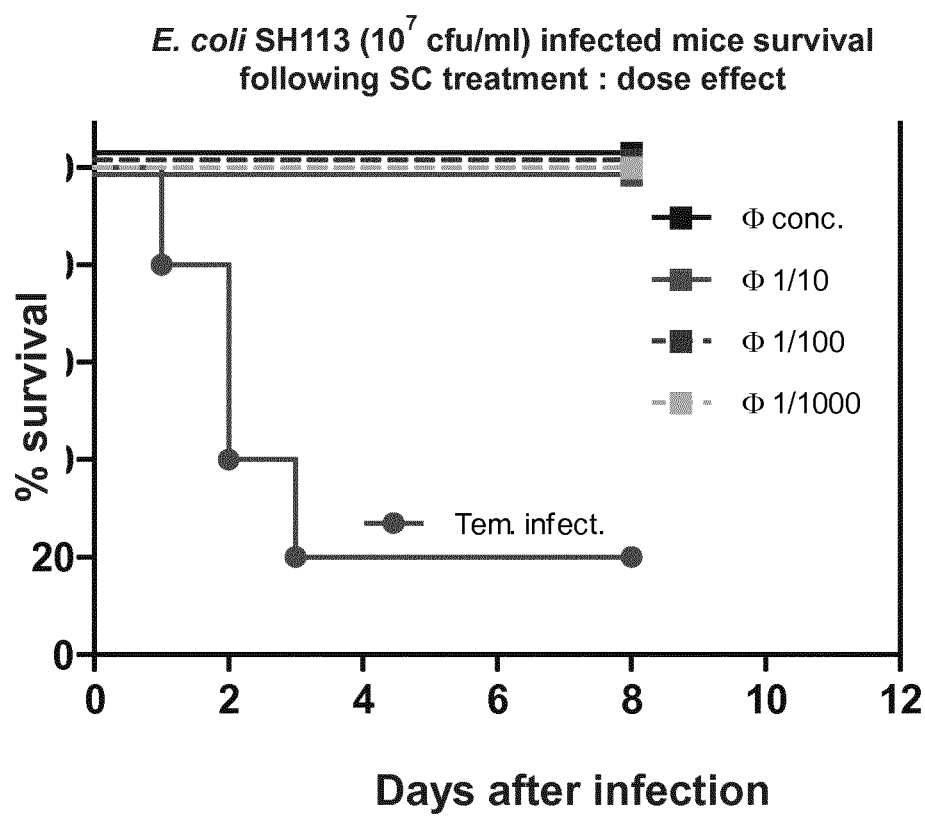
FIG. 4: Efficacy of bacteriophages of the invention on SH113 *E. coli* strain-mediated infection in vivo: dose effect. Φ conc.: full concentration ($10^8$ pfu/ml); Φ ⅟₁₀: 10 fold diluted concentration; Φ⅟₁₀₀:100 fold diluted concentration; Φ ⅟₁₀₀₀: 1000 fold diluted concentration; Tem infect.: infected antibiotic treated control.

A remarkable 100% survival rate was also obtained after subcutaneous treatment with 1/10, 1/100 and 1/1000 (i.e. $10^5$ PFU per mouse) dilutions of the cocktail of the invention (see FIG. 4).

Accordingly, the compositions of the invention can treat an infection in vivo and can induce a 100% survival rate in infected mice.

REFERENCES

Afifi, R. Y., and A. A. El-Hindawi. 2008. Acute necrotizing fasciitis in Egyptian patients: a case series. Int. J. Surg. 66-14.

Brzozowski D., and D. C. Ross. 1997. Upper limb *Escherichia coli* cellulitis in the immunocompromised. J. Hand Surg. 22678-680

Clark W A, 1962, Appl Microbiol. Comparison of several methods for preserving bacteriophages. 1962 September; 10:466-71.

Corredoira, J. M., J. Ariza, R. Pallares, J. Carratala, P. F. Viladrich, G. Rufi, R. Verdaguer, and F. Gudiol. 1994. Gram-negative bacillary cellulitis in patients with hepatic cirrhosis. Eur. J. Clin. Microbiol. Infect. Dis. 1319-24

Drulis-Kawa Z, Majkowska-Skrobek G, Maciejewska B, Delattre AS, 2012, Learning from bacteriophages—advantages and limitations of phage and phage-encoded protein applications; 13(8):699-722.

Fraser, N., B. W. Davies, and J. Cusack. 2006. Neonatal omphalitis: a review of its serious complications. Acta Paediatr. 95519-522.

Krebs, V. L., K. M. Koga, E. M. Diniz, M. E. Ceccon, and F. A. Vaz. 2001. Necrotizing fasciitis in a newborn infant: a case report. Rev. Hosp. Clin. Fac. Med. Sao Paulo 5659-62.

Needleman S B, Wunsch C D "A general method applicable to the search for similarities in the amino acid sequence of two proteins." 1970 March; 48(3):443-53.

Rodgers, G. L., J. Mortensen, M. C. Fisher, A. Lo, A. Cresswell, and S. S. Long. 2000. Predictors of infectious complications after burn injuries in children. Pediatr. Infect. Dis.; 19(10):990-5.

Stone R. 2002. Bacteriophage therapy. Stalin's forgotten cure. Science 298, 728-731 (DOI: 10.1126/science.298.5594.728)

Tourmousoglou, C. E., E. C. Yiannakopoulou, V. Kalapothaki, J. Bramis, and J. St. Papadopoulos. 2008. Surgical-site infection surveillance in general surgery: a critical issue. J. Chemother. 20(3)312-318.

Weinbauer MG. Ecology of prokaryotic viruses. FEMS Microbiol Rev 2004; 28:127-81.

SEQUENCE LISTING (15 sequences)

SEQ ID NO: 1 - DNA, 78554 bp, artificial sequence
  BP539
ggcctttctctcactctttaaaggggtactaaataaacgggtaggtaatgtattgggtagtatacacgggggaataactacggggagtaggcacggggaaaggtggaacgttgaaagggaaggtaaaggcattgccaataacccttttttaaatgaggactccccctttttaggaaacgcgcggcgagcggctagccccactcggtcaaatcagaattttaaactcttatatataaggttgaaagagaacttatgtggaaaattaagttaatcattaagcaattcaaatgcgatcatgagtactatcggatacgcaaagcttacggggatgaaagagttcacaccctttataagtccacttggagatgtagtaaatgtggtaagcttaaacacagcacatggatggataggccttaacgtgacatggcctttatgaagccccctttatatcagagacggggttatcagtgatgactgtgcctttacgggtaggtcttatgatgtgccctttatacttttattcagaggagaagtattatgaatttagtattagactttttatcagagatggtgcctcggttcagaacagagacatacgctttcgtaatcaacagtgactctgaagaagggatggaagctacatgcttaggtcgacttgttgatttagatgatgaaacagattttgatattacaattgatgtgagtagcttaggttggctcttcttcagagcattccgcacttacaaagtagaaacgtataaagattacagcaagggagatacagatgaataatcaaataatcgcagttaatatggaaggtgtttatggaggtagtttcccttctggttctcctttccacatccaagcgatggaccttaacgattacaattcacagctgtgtcgttctggttgtagcctacaacatctagaaactatgggaaacatctcaggactagctgtacaagatttatatagtggaagtattcttaaaccaaatattacggagaacaaaaacatgctagatttgattcatactactcgccctgattctaaaactaaaacacaaccatctactctggaagtaattgaatatgaatctaccaaacatgatcacctccctgactatgctcgtgcaatgattgagatgattgaagaagctgaatatgaaatgctccatgattacattacctccaaagatgaatggcatcgtgatgttcgaatcgaagaggatggtacagaaacaattacgtggattcacaagagtgagctagtagacgacgcactgcgagactacgaaaaatttttggtcgacggctctattgttttagaggaagagaagggtgcagaacttccgtgggaaggtgagacgattgctttaggtaagatgtttaacctgtccgttggtgattgtaagtaatatttgcctccgttgggaggctttttgtgttgttgataatgtagaaggagtataaaatgtttggagaaaacggagaactcacgcctgcacaggtagctgagattacaggaagattacccggagtaacggaagaacttgaaggccgtggtatgaacccaagcaatgggaagtttcaaaagggaaataaattcggacgacccagaggtagtagaggtaaactgacacaattaatgttggaccgtgttgctgcaagtcatttgtctcctgatgaagtgttaattcaaatttacgaagatcctaatattccacctgatcttagattcaaggctgcatcaaaagttgcagatctggtatatcctaaggcggcctctgttgaagttaagattgaggaagagaatgtaatcaacgaagaatcattgaatgcacaaatcaaggacttcttgactggagcacttggtatcgacgttatgcctccagaagaagataactctgaggacgctgaaaagggggaggaagcggacgagagttaagtaaaggaaacagggagctgtcgaagatcatctgattaataatctaaggattgttatagttttattgccacgatgttcttttgcagtgtacccttgtagtggagaggggaggttctttgacgaagggactttcccttttctatttttaaactggaggaagtatgtcattagataaacaaatttatgaagctctaactggtaacaaccttagtgtagaggaaaagaaagcactattgaatatgttgaaagagcgtgaccaatggaggaagtataataagattttgtctttcaaggcgtatgacttccaaaagaaattttatgcagcaggattgaagcatcgctttagattcttgtgtgcagcgaaccgtgttggtaaatcttatagcgaggcatacgagtttgcttgtcatgtcacaggtcgctacccaacttggtggacaggatataaatttaaaagacctatcttagcatgggcagttggtattacaggggattccacaaggaaagtattgcaaaaggaattgtttggtacacctatcggaaaggatacaaacttattggggacaggtgtcattcctcgtgatgctatcgtcattgacacgatagaacgagatggtaacaaacttcaaatcgtacaaatcaaacatcaaaacgaaagaggagagtttgacggtttaagtacattagaattccgttcaacccaacagggtgaacacacattgatgggtgcaacagttgactacatttggttagacgaagaagatccatacgagtctatggctatattcgcacagtgcgtcacacgtacactcacaactaaaggtctagttacaattacagctacaccagagaacggtttaactgaactggtagataaatttatgaaaggtgaaggggatgagaacacaggttctctatatttccagaatgcttcttggtgggatgctcatgcagacctaggtggacacatcactgaccaagatataaaagatatgactgaaggtattccagcgtggcagttagagatgcgttcgaaaggtatgccattgttaggaagtggtttgatatatgatgtatcggatgacacaattaaatgtgaaccattcgaaattcctgatacgtggaaacgtgtctgtgcaattgatattggtattgatcacccaactgctgctgtttggacagcttacgatgcaaacactgatactatctatgtttacgactcgtataaagaaggtggctttactccagtgtatcatgctccagctattaatggtcgtggtcagtggattcctgtcatcctaccgcatgatgcggacaatattgagaaaggtagtggttcatctgttgctcaattctataagaatgcaggagttaacgtacagagtgagaccttctacaacaaaattggaatggatggtaaaaagaacttctttgtagaaccgggaatcacagatatccgagaaagaatgatgagtggacgctttaaaatctttaacacagccgctaacgctaagctattcgaagagaaagctagatatcaccgtaaggttggtaagattattaaagaacatgatgacttaatggatgcaatgcgctattcagcgtgctctgttacacatcgtggtcgctctaagcatgacgttagctacggaagtgcttctctgtatgaggcaaacgtaagcagatggaatcagagttactaaagtaagggggaggtttgtcctcccttcttttatttaagctatcaaccgagggagagaatcgatggctaagcaaaaatatagtgaagaggtgttggacgagttacgtgttgaccttcaacgtcgttttaattacgctcaaggctacgtggacatggctgttaagggctatgctcgtgaagcttgggaatatttctatggtaacttacctgcaccagtaactgctggcagctctagttgggtagatcgtactgtttgggaatctgttaacggtacattgcaagatattattaacgtattctgttctggtgatgaagcagttactttcgtagctgacaaccaacaggattctgatgctgctgacgtagcaactaaattagttaaccaaattcttctgcgtgataatccgggatacaatattatctcttctgctgcacaagaatgtctggttactcgtaactcttttatcaagtattattgggatgaacaaacttctactcaaactgaagaagctgaaggtgtaccaccggaagcattggctgcatatgttcagggattagaagctggtggactcaagaatctggaaatcttcaccgaagaaaatgaagatggtacagtagatgttaaagttacttacgaacaaactgttaaacgtgtgaaagttgaatatgttccttcagagcaaatctttgttgacgaacatgctacctcttttgcagatgcacaatacttctgtcatcgtgtacgtcgttctaaagaagatctggttgctatgggcttccctaaagacgagattgaagcattcaacgactggacagacacgatggatactactcaatctacagttgcttggtctcgtactgactggcgtcaggatattgatgctgatattggtacagataccgaagacattgcttctatggtttgggtttatgagcactacattcgtactggtgttctagataagaataaagagtctaaactctatcaggttattcaagctggtgagcatatccttcacactgaagaagtaactcacattccgtttgtaaccttctgtccgtatccgattccgggttccttctatggtcaatcggtctatgacattacgaaagatattcaagatttacgtaccgcgttagttcgtggttatattgataacgtcaacaatgctaactatggtcgatacaaagctcttgttggtgcatacgaccgtcgctctctgcttgataaccgtcccggtggggtggttgaaatggaacgtcaggacgctattgacctgttcccataccataacctacctcaaggtattgacggcctcctaggtatgtctgaggagcttaaagagacacgtacaggtgtaaccaaactaggcatgggtatcaaccctgatgtgtttaagaatgataacgcttatgcaactgtaggcttgatgatgaatgctgcacagaaccgcctccgtatggtatgtcgtaacattgctcacaacggtatggttgaattgatgcgtggtatttacaaccttatcagagaaaatggtgaagttcctatcgaggtacaaacccctcgtggtatgattcaggtaaatccaaaacaactgccagctcgtcacaatcttcaagttgttgtagctatctctcctaatgagaaagcagaacgtgcacagaaactgattagcttgaaacagctgattgcagcagatgcacagttagcgcctctctttggtttggagcaagatcgttacatgactgcacagatctttgagttgatgggcattaaggacacacataaataccttctgcctctggaacagtatcagcctccagaaccttctccgatggaaatcctccagctcgagatgactaaagcacaggttgagaacgtacaggcttcttctcagaagatgattgctgatgcattcgaccaacgtgaacgtactacattcgaacagcagaaagctgcggatgaattaagtctgcgtcaggaagagttgcagttcaagcaagaaaatgcagcagatgcaatgactctggaaaaccgtaaagaagataacaatgctactctggaacaagctaagcacaagttagctcttatgcaacagcaggtccgtcagtatgaatctgtactgaaagaattgcagatggttatgtctcatcaggtagaccaagagaagattgttcagcaagctcgtgttcaggataaaactttggaactccaaaagaaagaagctaatgtaactaagaaagagcaacaagcttctctcaaagattcacggattccaggcaaacgtcttggaagtaaaaactaaggacgtcgaatgaacattagacatcaatttaataaagagcacgccgccgctttggcggctctcaaccttaacggcagtcttgacgcagcattagaggcattgaaagaaagactcatgacagagatagttcaaacagaacctcatgagaataagaaacgcgaagattgttatcaaaagtataaaatggttggtagcttaaaagaggtcataaaagctgctatcaatagtgcaggagatgtttcataatgccacaagataattatattgacccgaacgattttaaatctttcctccaactggatgacctgaaaggttctttcaaagaagaactcggtcgattagaatctgaacaagaaccagaagtggacattgacgatgagttcccggaaaaagacggtgacgatttcgactttgataccgaccttctcggtgaaagcgatgagcttaagttcgaagatgaagatggttgggaagatcatgaagaggaaggcgaagtcgaagaagatgaagaagactcctctgaagcagaagaacaagaggaagaagattcaagcgatgcagagtatgaagatgattctgctgacggtgaaggtgaagtctttgatgtagactacgaaaccgttatcacccttcctgatggacgtgagatgactattgaagaactttctaatggctatcttactggtgctgatatgacagaacgagaatcaactcttcagcgtcatatggaagcattcgaggaacgtgtagtaggtttgaaggatgtattagaactagcgtctttagaagcagaccgagtaattgaagattataacggttttgattgggacaagcttgcagtagaagatcctcaagcatatgttgaaaacaaacgtttcctagagaagtacacagctcgccgtcaacagcttgaacaggctcaggtccgtattaagcaagaagcagcagctaaagagcaggaagctttccaagccaagagcattgaatgtgttaatattctgaaacgtgagattccaaattgggatgaaaacttatatcaaaacttaatgcaatacgcaattgacttaggtgctactgaagaagaagtattgaaggaaaaccgtccgtctattttcctagctctccataaagcataccaatttgataaaggtaagcaacaggtgatggctaagattaaacgtcccggtgctccacgcaaggttgtgaagtctgatgctgcaaagtctcgcacttccaataagcccgacaacgctaaggttgccaaggcattcgcagagggtcgcgttagtcacgaagacgcattcaaattcctcgtagattaatcgacaaattaattattaatagtataggagctaacataacatggctaatccaactttatttgtatcgtatgaccagaatggtaaaaaactttcttttgctaactggatttctgttctgtcccctcaggataccccgttcgtatctatgaccggtaaagagtctatcaaccagactatctttagctggcagaccgatgcactggcaagcgttgacggtaataacgcacacgtcgaaggctctcgtgctgaagacggtgaaatgaaaccgactgttatcaaatctaacgttactcagattctgcgtaaggttgttcgtgtttctgatactgctaacaccaccgctaactacggtcgtggtcgtgaactgatgtatcagctggagaagaaaggtaaagagatcaagcgtgacctcgagaaaatccttctgtccggtcaggctcgtaccgacgttctggctgaccagtatctgactaactctgcaactgatcctgctgttgttggtctgaatgacacccatgcagctcgtaagactggtgcattccagttcctgtgtgctcacggtggtctggctggtggcgttgttgacaagaccaagaatggtcctgctgacccggacactggtgcagtaactgttaaagttgcacagaatgcttctaacccgaccactaacattggtttcgacgaagctgatatctttgatatgactctgcaactgtataccgctggttctgaagcagatatcatcatgattaacccggctcatgctaagatctttgctggtctgcaagaaaatactcagggttcacgtaagcgtatctttgagaacaccaagcagttcatctacgaagttaacagcatcactgacccgctgggccagagctacaaaatcatcgttaaccgttggatgcctaccgatgcagtttacttcttccgtagcgctgactggactcagatggttctgcgtgctccgaaacgtactgaactggctaaagacggttcttacgagaagtggatgattgaaatggaagttggtctgcgtcaccgcaacccgtatgcttccggcgttctgttcactgctgcgggaaaggtggcggcgtaacagtagacagtgtgactgttagccctgcgtctttagcaagtctagagacaggggctactcggcagttcactgcaagcgcggagaaaagtgatggttctaccgaaacaactggctttacttggtcagtgacaggaggtggttctatcactcagtctggtttgtatactgctccgagtgcgtctcaatccactgatgtatccattactgcaactttagaaggtgtttctggtacagcaaccatttctgaaattgttgctcctgctcctactattgtagctaagggtccaattacgggtaaaactggtggttcttccactaatttcactaccatgtttactgtaactaattctactgctgcggattacacgtttgttgtaacccctacagaagctggtacagtaagcgccgctggtgcgttaaccttagatgctgctgcaagtggcgaagttactgttcaagcaagtttgacagctgacccatccatcaatgcaacatgcacttttactggtgtaacacctgcttaaaactagaccctgccttcgggcggggttttttcgttttaagacctatacaagccagtgtgtaatgtatattctttgtctacatataacaaggaggacaacctatggcaatgccagatgttcaataccccatcaatacctatgggtggctaaagaaggccgtggccctctgggcagatagggacgatgacgaatttgttaatcaaattccaaactttattaactttgcagagaaagagatttatcgtaacttacgtattcctcctctggaaaaagaagtgtatttagatattaaagatggagtagcttacattcctcctgattacttagaagctcaatggatgatgagagccaaagatggcacaatcttccaagtaacctctcctgaagagattagctatcgtagacagcatggaacaattaacccatctcactggaataaccaacctgtcaactttgctcgtttcggtagtcgtttcattttctaccctagcatcgaagcagatactccgtactaccctgatgatggaagccctttgattccagcagaaaactcagtgattcttagctattatgcagacccaccggaattccatgaagatacagatactagtactattcttactatagcaccagaacttcttctgtacttcaccctacgtcatgcttgtctctttgttcaagatgataatggtgttcagaaatggtcagcattaggaaaagctatccttgatgaaatggtagaacagaataagaaacaagagtactcaggttcacctatcgcaattccgaataacatgactcgacttcagagcagcttgcctgatatttatggtattcgtacttctcgtgtataaggagataatatgatcgtttataataaccaagcacctgatgcagtgaataacgttgggcagtttggtgctactgaaggctctatcggagcttacaagcaagcagcagaatatgcagctgactccaaatattgggcactgctagcagaatctaagtttggtacaattgatgatttaatcactgaagtagaacgtctgtatcaacagggtgttctgatgaagcaggatattgaagatcttaagcaggattttaaggatcaagatgctcgtttgatgactctgattgcccaaaccaacgcagcagtatcggatgctaataatgccgttgctctcattaaccaaaaacttattgaagtccagaatcagcttgatgttctgttaggaatgtctgttgatgtaacaactctccctccgggaactccggctactggctcttttaatcctaacactggtgtaatctctttaggtattccagaaggtgatcccggaaaagatggttctgttaaggatttggatacagcacctacaggtgttccagagctaggtgatttaggtttctatgttgacaaagatgacaataccgtccacaaaactactctagataacattgctaatttaatcccatctgttcgttctgtctctattaacggcggtccagctcttgatggagaggttgctctaacacttaacaaagagacggtaggtttagggaatgttctgaacgttgctcagtacagtcgtcaagagattaatgacaagtttgataaaaccaccaagacatatcaatctaaagcagaagctgatgctgacgctcagtatcgccaagttggtgagaaggtcttagtttgggaagctactaagtatgaattttatactgttgctgctaacaaaacattaactcctgttaaaactgaaggtagaattcttactgttaattcccgttctccagactccagtggtaatattgacattaccattccaacaggaaacccttctctatatcttggtgagatggtaatgttcccttatgacccaacgaagaatatctcctatccgggcgttcttccagccgatggtcgtctagtgtctaaagagtctgcttcagatttaggcccatcccttgtcagtggacaacttcctgttgtttctgaaactgaatggcaagcaggggctaaacaatacttctcttggggtaaattggcagatggtattaccgatgcagattctactaattttatcaacattcgacttcctgattggactggaggggaggcaataagagcaccagattctgataaagactctcagtacaatgggtctgtacaggctcagaaaccttatgttgttactgtaaataaccaagctcctgatgagattactggtaatgtgaacatctccagatcaattttaggtgctgccgcttctggtacaaactctgatataacatccctcacgggactcactacagcactgtctgtcacacaagggggcactggagctaaagacgctgctagtgctcgttctaatctaggtctaagctccatagctacactcaacacaattcctatagctaatggtggtacaggggcaactactgttgatgctgctcgttccaatttatctatagatagagttgatcaagcctctggggagagtagattactatctcctaacaaagaaacctacctctttgtggataataatgggtggggatgttacagtacctcgcctggaagagttggcgatttggctctaggtgttgaaagagggggcactggagctaaaaatgctgctagtgctcgttctaatctagggttgggaagtgtttctactctggataatgtacctattgctaatggtgggacaggggctggagatgctgctggtgcaaggttcaatattggagcgctaagtaacaccccagcaaattcaggcgtaggtggtactggggatcgtgtccaacatgcctccgggaacggcctgtttactttagacttgtttaactgctactggtatatgcagccagaggatactaacttctggattgcccacggtgtgtcatatgcagggtctggtggcgaagcctcacaatacggtcgcatatcttacgcaataaagattgcagacggaacaataaaatatgtccattgtcttacaaacaaaaacaccactgttgatgtaaacggatttatcaaagcggcatctccggtagttcatatttactccgacggtcgatatgagacgaacgaggaatctgagggggttaatgtcattcggcaaggtgttggtgagtacttgattaccggttgccttggcttaaacgcagatgcaaaatggggaggcattgacggcggctttgaaatccctactgaccgcaacaaacaacctagggtttggctggactatgagattaaagaagatggttctattttagttaaaacctatcacagaacccatccaacctctccggtttttgctagaaatgagatagaaggtttttctgacggtgatcctattgatatcccgagtgatgcttttatttcagttcgtgttgaaatgccttctgagtaatttaacaatgctcccttcggggggctttaaggagatttaaatgtctagagaattaatgcccaaatctggtataatgatgcctcatgtggttgtaaccagagacgcggctgttgttggggtttctactgtagatggacaggctggagctattaacctcaccggaaaatatttacagaaaaccgacgcagctgctacctatcaaactaaaacagagggtgcatctaaagattttgtgctggattcgattcaacctattatgtctggtgcgctgttccgagaagacccttgggttgttaatgataccccattccgttctactggagctaatggtgtagaatcagttgatatgatgaaagttactactgataactcaatcaagattggtagttatgcctcttcagttcaaggcgtagagattcattctgctggtcgtcttcaggttgttgaccagaatgactctggggtagaaactaagtatccagtttattctaaacgttaccgtcctgagattgaggatttgccttttgctgcaattggttcttatgttaaagactctaaaggtcgtacggtaggtgttactcgtacagggattaactctgatatcaaacagctcacacagaaagttactttcactcaaccagtaactgtccctgatgcagttggtgattatgatgcggttactttgagacagcttcgaaacagtggtggtggctctggtggtcctacgatgagcggtatctctaactttggtattggtgatttccatttacgtgacagtcgagcttttattccagcttttgaggtaacgtcagacggtcagcttcttaatcgttcagagtacccagatctctgggcttatgcacagctgttatcccctatctcagattctgaatggcttagtgatgcccaaaaacgtggacagtactctactggtgatggttctactactttccgcgttccagaccgcaacggggttcaggtcggttctattagggagctatttggtcgcggtgatggtggtacatcatccaacgatggtgttatctatgattctgctgcacctaatatcaaaggtaaggtcgctggtgtatcagccgggacttatgcagggatattcgggacgtctgtgcaagattcattctatacggataacagtttgtatccggctggtggaggggacactatacctccggggtccggtgcagttgatggacgtaataatactctagtcttcgacgcaagccagtccaacccagtttatggtcgttatagtatctctgacaacattataccgagaaactttgtgggggtttggactattcgtgctcatggtggatttgttgctgctaatacttcttggtctgttattaatagtgacaccacacgaccttccaacggaacgaaagtttctagtgggtcagttgtctctgagtataaaatcggttcagaagtagaagcttctactactctcaaaactgatgcctacatcaacggagcttactatggaatcattgacgtctataataaaactaaaggagttaccaagcagttagctttcgacgattctggtacactgaattctgataggtatgtttctagatttggcactttgatgtcttggagtgaaacaggagctaggaaaggaacattctccatggacaaccaagggttagggtctaacttctccttcaattccatactaagtgcttctcaaacatctagtgggggatacaagaccaccactcatgttggcatgattcacaacgacgccggaacttttgccgattcttgctggcacgttgcaggtgatgaagacaacaaatacggttgtcgcctaacccttcgaccaaacaggaatgagattttctattatacttggcaacccagctctactggaacatatacccttgccttgaatcctgtgtcagatgaaaggttaaaacataatatccaagatatttcccctgagaaagctatcaaggctatcaaaggtttggatttcaaatcgtttgtgtacaacagtgatgaacaaggaagaactcgtcgcggtgttattgcacagcaagcagaaaaggtagaacctctttatgttaagactcgtaggttccacgacaatgatggtgtagagcaagaacagaaagagctagactcagctcctatgctccttgatactatgcaggttgttcaagaccttctgaagcgtattgaagttctagaagcaaaactagcagagaggtaatataagccccttcgggggctttagtagtgagtacccttagtaagtaatgaaactaatatatcccaagaggttaatatataggagacactcaaatgaaaatgatgaaacaagctgcatatggtttaatatgtttaggcgcaggtgttgtggtatccaccgcagttcctgtaggcgcagttcatccattagtaactgtccctgctccagtagagaagcttagctctcaatgcaagcagagaacaattcaaaataacttagttgttatttgccctgatgctgaatctaacgctctgagaaagatactaccttaatttaaagggactacaaaaggaggttagaaatggataacgtcgcattgccacctgtacaactaaacttaagcccagctggaatggaattcatcatgaagcatgagggtatgagaacaaaggcttataaagattccgcaggtatctggactatatgtgtaggggctacgcgcgatatgaatggttatccggttagacaaggattaacgtattctatagaggattgtctagctctgctagatagagacacacaagactctgttcgtgctactcagaagaacataaaggttcctttactagttcatgagtttgatgcactcacttctttcaacttcaatgttggcagtggggctttgagcacatctaagttaaggaaggtaatcaatggagatgttaagggggatgtttattccgaatttcttcgttgggataaaataacggtcaagggagagaagcagagaagtcagggtcttcataatagaagagttgcagaagctaatctttacaccgaaggtaaatattaatggaggtgccttttggctatcgaaactaatgcggtagttattaccgacttaaacccactctatcctagagacagggattacatctacgaaggggcggctcaaatccgcctcattaaacaaacgttacagaacacattccccaatgttacagaaccggttgatatagattctgacacctttaagattatgtcagagaagctcaagtttactggtgatgcaatggatgttggtggtcttatgatcaagaacgttactccgggaactggtgacaaggatgttgttactaaaggtcagatggaagcgttcatgaagaactggatggagaataagctctatcgaattggttcttactacatcactgaagaagatattaaccccggtgattctatctccttagggtttggttcttgggctaaagtgactggtgtcattatgggtactggtgtagtaaaccctgatggttctgtccctaatgctcagagagttgagttccaagcaggtggtactggtggtcgtgtcttcaataccattcgaactgagaacgtacctctgatgacagttaatggctccagcttctctctatccagtaacactcacagtcacaatatggtgtttggtcgtggagatgctagtggtcataacagctcaccaaactggtatagtccgggtggtggttacagtcagagaactgatagcgacactcacactcatacaatctctggtagtgtaagtcttggtcgtgatgatatctctcgtcaacctattaacactttgccaccattcagagcagctcacatttggagacgtattagctaaggaggaattatggcgctgtatccaataaagtcactaggtgctgtaggcgttatcgctgatcaggctccgacagacttagctcctaatgctttcactaatgctataaatgctcgatttgttgagcagagagtatttaagacggggggcaatgcccctctttcttatgtagatgaagataaggatttaacccctctgtctttcgtttctatgcctttcgattattatagcgcaggtaatagctttcttgttgtaggtacggataagaagttatataaactgacagatgaaagcttgactgatattagccgtaaggttgctacagtcactaagaaggcttctgcctcaattaagatttatccagttgtttctcagatcgttcctaaagaatcaactatctcaatgaacttcaatcagaccaagaatctagaggtttctcttctccctgctgatgctaacaatactgatcttatttgggaggttagtaactcatcctatggaagtattacggtagaccctagtgactctaaacttgctactctaacatcttttgagaaagaaggtaatcttgtagtaactatctctactgccaacgaatccgtagtggctcagattgctgttaatatcatcgacggtgattcaggcatcttcttgagtcaagacactgttacaattcgtaaaggagggactactactctcacggctgttactggcaagactcctgtaacttggtccagcaataacgcttctattgtatccgtaacccctaacgccaattctttaactgctgtcattacagcgaatggagaaggtaatgtaacaatcactgctgataacggaactaagactgcttcttgtgaggttgtttccatccctcagattgatagtatctctttaagccagtcagatgttactgtgagtagaggttctcagtatatcttaactgctaccctttctcctgctaacgcccctaatcaaaatattacttggacctcttctaatccaaatattgcaacagtatcagggactagcacacaagggacgatcaacgctctacttgctggttttactgagattacagctaccactgaagaaggtaacagagttgctgtctgtactgtacgtgtggatttagctggaaggacaatgaggacaagtgctatggcatttgctgctcctgtgtcagagccagtagaaactcaagaggaagaagtagtaactcctcctgaaagtgaagagacggtttattttgctgagcctacatccggtattgatacgtcagggatgtacgaaggtaataacttctatgactactctaacgtgaatgacattgaaggttttgcaagagcttctttactggcaacccctttgtcatctgtaaccttagatgttgtcagcgcctcacttgatgttggtgaagagattgtcattacagctacggcttctccagaaggtgattattcttatcaatggtctgttgataaaactggctatgtttctacaacttcagtcactggtaaatctatcaaactggttgctctccgtaaaggggagattaatgtaacttgtactgttagtcagatgactcagaaagattacgatgcttttgatgactatccttggtatcacgctgttatctctaactgtgcagttgctacaactcactatgaaactcctcaggtaaaagaattcgaatcagaatactttgtagaccttccggggtggggtgagcaaacagttgttgataatgatggaaacccttcagtcaagaagtttaactggaaatgtgagagagtaagatcttttaacaaccgtctttttgctctgaatatgagagaggctaatgcttctggtgttaccactaactacccgcttcgtcttcgttggtctaactttgccaatgagaacaaggctcctacactgtgggatgactttgcctatgatcgagttgtgtcttcggacttagcttctaatatcgtagggcagactcaggctctagagaatgggtatgctggttacattgacctagctgactctaatggtagcttgattgatatcctacctcttaaagactacttgtttgtttatacagagtttgaaacgtatattggttctccaactaataacacgtaccaacctctaatgttcaagaagctttttaacgactctggtatccttgctcctgagtgtgtggttgaagtagaaggtagtcacttcgtagttactcagaacgatgtaatcttacacaacggtgcaactaagaaatcaattgcatctaaccgtgtcaagaacatgctgattaacgaggtgtgtctggttaatcctttagcaactcgagtacacttgcatcaggataagaaagaggtttgggttctgtatgtaggtccgggggagccaaaagaaagcttcgcttgtactaaagctgctgtatggaactacgagtttgatacttggtccttccgtactatcccatatgctcagtgtattggtctggttgatcctcctgttttagaaagaggtccaatctggtccgacttccaagaaatcacttgggatgacccatctattaaagaactcgtttggagaaaggatgcaacaaactttagacagagggttacgatagtaggttcattcttgaagggattctatcaagtggatgtgggtgctcttgattacttctatgacaggctaaatgatgttgttatagagaagcctctggaaatgaggttggagaggactggtatagattttgataatgtgacgaatgagtggaatcagaagcatattaacagattccgacctcagacaactggctcaggtacttacatatttgaagctggtggtagtcaattctcaaatgaatatggacacccacacacatctaagacatatacgatcggtgttgacaggcatgtctcggtgagactgaaccatccataccttttctataatgttatagataatgatgttaacagtaatgctgctatcaatggtttaacgatagagtttgctgttggcgggcggagataacaacaaggggcttcgtgccccttttattgttttggaggaacttatgggtgcaggtggttttcgtaagaatactggtcgcaataacaccacactcccgtacaacgttgggtttctcaataatgtacaggacacagaaacatataacgtagccgtatatgatgagctacaaaaagtcagtacagctactaaccaaatgttccaagctattgatgagattcacgatgagattgatgttcgtatcaaagctctccatgcgatgaacttacaatttgatgagcttgagaatagaattactacagagatagagacagctattgccgatatccaaacacagatggggaatctctccactgaagatatttgggataattctgttcaaccccctgtgaagctagaaagcactgtatctggttttaagaccagcatcgaaggtaacacaactaaaattcagacagtagaaggtattgttaacgatcaaggtcaagagattgctcttgttcagacagaactgcaaaatatcaacggaagcctttctcagtatatgaaactctctgagtatgaagctacgtggggtgttaactctacagtcaacggaagatatgctggggtcaagttaactaacaacggaacaaacagtcaattccaagtaacagctaacaaatttattgttggtgatggcagctctgggaatacccccttcgtatttgagggtgggcgagctaggatggaattcgctgacataaagaacgtcaacatcacaactgctcagattgccaacgctaggatccaatgggcacagattgataacgtatctatctccaatgctcagattcagaacttatcagcggataaaatcactgctggttctatgtggggttctaactggagacttactgttggtggtgattttgttatgggtggtacaggtggttctcagttgtggatgaatggtaatagaatagatttttatgatgggagtggaactcttcgcataagaatagggagttggtaacatggcatatggaatatggacacgcccggttggtccgggtccagcggcacctgctgatatttacatcgatagtggtagcacattccctcaactcagaaatagagtcagtgggaatttctcttttagtggaaatacctgtgacttgcctataagtggttgggatggtagtggtcagatagttgtagttccaacagggtctgttgtttgggagagatacatacctcctaacgtaacgtctgatgtgtattggataacggatatatctgttattaataactcaaccttcagagttactatggactataatgtaaacggttgggtatttgatatggcttttaatgtgtatcaaatatggcctagagctaacaggaattatggaatcacattctccaactctgctgactatttctcaatatccgattctggggttgttggtcaatgtatttgggcttgggagggtgacataaatggttctcttcaaataccagatattggtggttttgatatgagccgagcaactgtctacgcgaattggagtaacggtggagcagggctgctatacaatccatccaatagggttgtttatgtgtaccagaacaggtctcatgataatggtaacacaaaccaaacaggatacattggtggtgttagaattgccgtcttctgtgatggttctggagtaccaacccacaatggtggtttaaatatcttctctccaaatgggtctcagtgtgtattttctacatatagaaccccttttagtgttgagggatttatgcctatgagtggcggtaacacatctctggcctatccaatgataccactatcttacggagcaggagcaataagaggcaaggctagtggttggtattttcaacacacaagatctcacatgatgaatggctcttctttcggtacaggtttcggaaggatgatttactcttggagtagtcaatatgatttaggagggggtggtgccctcgggttaagtattccaatattagatgctagaaagatattcaggagtatacaataaggagatattatggcaatcagaatgggtatcgaagaactagacccaatggtacagcaagcttcaaagaagtatgggattcctgctgctttgattcatgctgtcatccaaagagagtccagtggtcgtcctacagtggcctctggaactggtcctgtaggtttaatgcagatcagtaaagggttggctaaagattacggttacaaactagaagatagacttgacccagcaaagaatattgatatgggcgctcgttacataagagataacttaaaagcttttaatggtgatgttaagaaagcaatggttggttattcagaaggtatcggtggagctaagcaaatgttcgctggtaaaaaggggtttactccacaagctcttgactccatgaacaataaacactttcttcctttctatggtgatgcagcttctcagattgctaaccctgttggagctttgcaagctgttcaaccagtcaatcagtttagtcctgacttgttagatagagagaaggccgcacaagctccaactcaggcagagattgctgcttctaagacaggtgctttaggtggaaatccagtagagttttactctgatgaagtgcaggaaggcgaaaatcagaaacctcaacagaactttggtaatgcagtattaggggtagctgctatgcttgctggtaaacctcccacttctcaaacagttcagagggcaagtgcaccacatgcagcaggttctcagtacagtccacaaacacaagcagtgctcagacgtctggctagcattggtgtaaagtaataatctttaaggaggacttatgtctttatttggaaaatcagcttctagcaaaaccacagtggccccttcctctcaggttgatgccctgctgaagcagattgttgctaatgctcagaatatgcagaacaacgatccgggattcatctcccaacaactggctgggtttaatggcaaccaacagggtgctctgaacaacttagcagcttctactactcagaagcaattggctgatatgtacacgcctcgtacacagcaagggttggaccaattaaactctcttgcacagcagtatcagaatattgtcaatggtggtggtctaactgctgatggtgttaataactttagtaaaggattgaataactcagctcttgctcaagcgactagtaaggcagcttccaatgtatccctcggaaatggttctgattcaggctctctccgtagagctgctgctcaaggtgctgctctgaacagtgctaatacaaacttagctcgtactatcagtggcaagaatatgggaatcagtgctcttcaacaagaccaaaacttccagaggggcttacttggtgctcagtcaggattggctggacagaatctcaaccttggtgctcaaggtgttcaggcaactcaacaagctatccagaatcaactcatggctggtaatctacaacagcaacaagcccaagctcaagctgatattaattggcagaacgctattggctctcaacagtatgggtggaatcagcttaacaaccaacttaatgtattaaatagtgtaagcccaatggctgggtacacgattaagaatgctgctccgggggttaatactggacaacagctcctaggtgctggtatcactggattaggtattgcaggtcgtatgggtgctttctctcctaatcaacagactcagaatgcttggagttcctataacaactcaggtgggcaatctggaatggctggtcctatgattggtggttctaatctttctcaacagaaaggtcagtctaactggttatccacagcaggtagtaatatcttaggtggtgtcttaggggcatttggagcaaactaaaggagatttgatatgggacttttcggaggcgggggtagtaaaactacttcccaaatgattcgccctgaatacattcaacagtatattgaccagcttaaccaacagattggtaatactagttcaggggattatgtttatcgtgacaatgtagggtttaataacaatcagacagaggcacttaacaacctagcacaatctggcgctctaggtactctctcacagcagtatatggatgcagcaggtcaaggcttgggttatctagataatgcctataaaggttatcagagcctctctggacaaggtgggattactggagagcagattggtgctctcgctggtcaactgtatgatgatgacgctgtgcaagcagccattacagctaataatgaacaggttcaacagaacttggcacgtaatgctcttcctcagttagctcaacagtttgctggtcaacaaggttcaggtgctcgtatggctaagtcttttgcccaaggtgatgctctgaatcagatgcaaggccaagcaacagatattaccaatagtgcctataactcggctattagccaagctgaaagcatcctctctggtaatagacagaatcaggcagctgctctctctggtctttctaatattggttctaacctttctaacctaggtcagcagggtgctaatttgtctcaacagcaaataatgaatcaatggaatgcagggttgcagcaacaacagcaacaacagaatgaatatgataatgcctaccagaatgctcagaacgcagctaattggggatggcaagatatcaataaccaactcggtgcagcaggtgtacttaacggtgctctcggacaaactacaactactaaaacatctggtggcaaaggtggtttccttggtggagctatgagtggtgcagcagctggctcttcctttggaccttggggtgcattagctgggggtgtaatcggtgggttggctagtacttaattaggagataaatatgcaacagacaacttacgctcaggtcagaagtcgtgacccgagaaatactttctatggtgttaatccgggagcggcttcggcctctccttatatggctagaccaactcagacagcagatatttctatgtatcaacgtcctgctgtaccttcatctcttgcgggtcttgtctctcaggcagaagaagatcagaatgctatggttaatccgggattccagcaacgtcttatggaacagcagaatcaagggactcctaccagtcttcagggtattgatattggagcaccggcccctgtagcgtctaaccctaacctatccactgatcaaggtttacaggatgctgggcttatgcctagtgaccctcttccggtaacacctcctactaaaccgttagaagctggtcctatggagtttactccttctcaggtggaacaggcacaaggtgtgattaatactcttgctcaaggacaagatactggtgatggaatggctgctgctactcgtgctaaagatcaggaacgtgttaacaatgatatcttgcaagttgctaaagctaaagacccttcagaagcttggaacaaattacagaaagaaccgttctatcagaactctagtttctacacaggtttgatgggtgtaggtctttccattatgtcaggtaagtctcctattgaagctttccagattggtcagggaatggctaatcaagatgagactaagaagcaactggaagctaaccgtgatgctctgattgaacaaggcttctctcaagactcgattgcagctgctattgctaacggagacccatctctactgaagatgagagctgtagaccctgctcagaaagaagcgttgtatgctgctcgtgaagaacgacaaaatgctgaatgggatagacgtcaacagattcaagagcaaactatgcgtgagcgtgctgatgaaactcgtcgtgccgctgaagaaagagctaacatgaactttgaacgtcagaaagagttgattggttatcgtgataaggttaaggctgaacgtgctgaacaagctgctcagagttttaactttaacccgaaagaagttcgtcttgctcagaatacagctgaaggtacggttgctaagcagtgggcagagaaaggtggcctgtttaaccagtctaacaaagacttggatttggctgataaggctgttaaggataaagactatcagacagctcgttctgcttacatgcaggctatcatgaactccgcaagggctgaaatcggtgctactcgttctcttaccgaagaagacttggggcactttgcagaagacccatcaatcttcattcgtgttggcaacaagtttgcactgaaatctggatggcgtcctactgattctgctcttgcttatgctcgtaagcaagctaacgttggtcacacctctgcaatgaaaggtgttgctgatgctaagagagctacgattgaagcttacatcggttctggtatggataagaagagagctactgcattggttaaccgtgcaatcccttctggtggtttctatgaccctctaggtgttttctctgaacaagcagaagaagcagttggtggtgcagcaaccaatcctaagctcaatggtgctttatcagctgtcgaagacactagctggtttactcaataagacctaagtcctgccttctataatgtatatagggggtaggacatttttatttataaaaggagacgttatggctaacattaaaccgtgggaagaagcttccaaagctcctgcgtatctgaatgcctctccggagcaacaagctcaaatgagagaacaatataaggcagcaggtggctctattcctgaggaacagccagtagcacaaccacaacaagaagaacgtggtgctataggtgagtttgctcaaggtgtgtcaaatgctcttcaatctggtggtgcaaatattgcagctagtgctgctaaaggtattggtggtttagttgagattggtgagaatctagctggagcacaaactagttatggtaagcgtatccaagagaactctcagaatcttctgaaagaacgtatggataagattgaggatgggattggtaaaactgtaggtcagtatgctggcgttgctggtgatattggtatgactgttgctaacccattggctgctgctgctatcatcgcaggtcgtgagacaggtcgtgcatatgcagaccaaacccctgaagagggggaagataaatctattctagatgcagccttagttggtggtgctaactatgcggctcagagaatccttccgggcgctgttggtacagctgagtccacacttggacgtattggtcagaacgttgctactaacgcagtggctggtgctaaaggtggcgctcttgtaggtgctgctgaagctcagaacaagcatggagatgatacaacctttgctgatgtattagaaggtgctatcgaagaaggtgctatgggtgctgcattcggtggtgcagttggtggggttcatggtttgattagccgtccggattctactgtcttcaagaacactccagagtatgcgaagactgatattgctgctgatgatgaactaattcgtagtgctaagaatattgatgaactgaaagaagcttactctaaagctgaaactgctaacgctgcttctgctctgaaccttctggatgagaatggattccgtattacagatgctgttgctgtagactctcctgctgctcagcgtattcttaatactgaccaagctcgtgctgagaaagctgcttccgttcagaaagaacattccaacattccgggcctcaaccctttagcttctcctgctaagactcgtggtaaagcattcgctgataacgagcacaaccagaagcaggctgttgctatgaaggatgcaatggctgactacaccaaagacaacacgaaagctcttacagatgttctagataatctagatcgtgaattaacctctctccgagcttctggtgattttactggtagtccgattgatattaagaaccgtacacaagccgaccgtgatttcattgatgcttacaagactttctacaatgaagcaaatcgattcaaagctcgtgatggtgaagactttaataactttgtagagaaagctgctgaactacagaagatggctgataatgtttctccagagatgaagaaagctatcggtgggttgaagaaactgaaaggcatgcctgaaggttttaatcctatccaagatgcttacactctgaacaatacggctaagtttatgagtaaccaagatcgtggttggacttccctgactgatgatggattccgtgaggcttcttcacctagtctggtaatgaacactctcggtgctgctaagtatgctctgaatcgcttctcttctcagcgtgctcgctctcaacgtgttaagcaacaagaatctaacagtgaagctatccgctctctagctcgcggtgatttggaagttgctcgtgctaagtcgactgctgatgaagctcgtgctaagatggaagaagaaccagttgttgatgacgttaaatttaagacgcaaaatgacgcggaaaccgaaccggttcgggagccttcttctagtactgtgatggaagaaaatcttccttcttctactcctcaagaaactcctcttacagctcgtgatttagttgcgcaaagacgtgctatccgtcaggctgaacagcgtcgcgctgaagaagaggcagctgctgctcaagaagctccagtcgaacaagctccacaggctgaacctctccctgctcgtaaccctttagaggagcgtcgtgcaatggaacagcaacgtgctcaagaagaggccgcacaggctccagaacccactgtagaggaaccaacagtcaaagctgagccattacctgcccgtgctcctaaagctcctaaggaagctgtacaggacgttaaaccggcaagtggtgtagaacgtttagctgctatgtctagtgctgctcgtcaggctactaaagatcgtgcagaacgttttgctcgttctctgtactctaaggctgctaaggctaaagctactgctgaaaacttcttggcttataaaggtgaccccaaggaattgatgcgtcgtattcgtcaggaagataatgctatcaacacggaacgtcatgaagaaatggctcgtaaccagctggcttctcagcaaggtattgctactgctaagaacaacactgtacgaactaattttgctgaatgggttaaggaacgtggtctgccagaagacattgctactaaggcattacgtgctgaagagaaaggtttaggtgggaacgtaactaacttggatagtctgaaacgtcgtgctgaaaggttgtatcagaagcagcgtgaggatgagtttgatagactgtatcaacaagctctagaagagaacaaagctttcgataagaaagatgctcctaaactggttgaccagaagaaagagcttcagtctgagattgatgctttgattgattcagaacctttacgtcctgctcagaaagatgctatgcgtaagctgatgaatgactttgtagatgggaagtttaaatcttcagagaaggctggtagggaagaggctttggaagttggtcagatgaaggatatttgggatgggtttattaacacctataacagagaagtgaatgccttcaacaaagctaacaagaactctcagtacgaagctgctgctaagcatttacaggctcgtgaagaacgtcttgctacactcaggaaaaaggctcaggctcgttcggatgctaaagctgctgttgagaatgaacgtaaaactctagaggctattgcagctcagaagagtgagattgagaagatgatggaaggtttacctaaacctgttcgtgaggctcaggaatctcgtacattgaaacagttggctgctcaccacgataagaactctccagttcctccagagaagttccgtagttacattgaacgtatccacaacgccgagtcagactaccttgatcgtcagcgtcgtttaactgatgcagaggaagatgctcgtcaggctaagtggaacaagatgtatgagcaagcggaagagatgaaccgtaagtttgatgtggacaagagagttaagcgcagtgaagagcttaaagcggcccaagagcgtgagaatgaccttatggcagtacaacgtcaacgtgatgacattcatcgccgcctgatgcgtactatggaagataagggcatatctagagaggatgctgaagcatttgctggttcctatatggataaccgttatgcacttcttgagaagcctatgactcctactgaacatcagaatgctcgttctcgtatcgaagctgatgttgagaagtttgctaagaagtacgaatcaatgactcctatcgagaaagagattgttaaggttactggagatactgaaggtaagcttgataacttggatgcggatactaggaaggctattgaggaggctcagaaggttgactctgatattaagaaactgcaagaggaagagttggagatggagaagattcgttctgctctgcctgatgatgaaagatctcaagcaaattctgatatcttggaaagcattaaacaacaggaagaggtctttgctgataaagtagagaaagctttcttgagtgggaagagcttggatgagttggctagtgtggctgaagttttagacagggttcatggtgcagataaggctggtaacaaccgtcgctttgtacgtgcattgcagactgctgctgaaaacaagaagaagtatggtgataatccagtagcttggtttagtgctgatgattactctgccattgctaaacttggtgcttcttccgcaggtggtaacaaatccagagcactggagaagatctttggttctacagctgaacaggctaagagtaagttgcttggtagggatgatgtagcgaagatgagacgtgtgattgaagagaaccctgatatcaagattccttcttacaagacaacaaatcgtactgagtacttgcagttcttggagaagtttaatgacgaagggaagcctaagattaaacgtggctcattgtcagagaagcttgaacgcagtaagcgtcaatcgagactccgtgtaagagttcgacctaaggagtgataaaagaaaagccccaaccgaaaggaaggggctttatttgtttctaagttttaaaaaccatcaaattcgtcatacatcccaattctcttcagaagtctggatgttcatcttcaaagcatcctgagatgcctccatagaaccaatccgatttacttccaaggataacaacttcttcattcatataccctcctagattgtgtttataaaattaataagcttctcttcgctttcatcaaaagcttttccagctgcttccatctcccaagtatgggcgttgtcgataaagctctgagcttctaatagatcgtggattaggtcgaagagtttgtttttatctgactgtgtgatcatattgtttcctagatcaaatcataatactgaataatatcagagagtttgaactctcgaatctcatctttctctacatctatcgctgtcataatccaacaaggtttgccaccgttatgaaaacgggagctagcaacggaggttcggagtggaataacggaccggtcagcaacctcgcctctccaattgcgatagcgaaagcgaagcacttgttgcgtagatttttgatcatcactcatttccttttttgaattgttttcttgcatcattctcttcttttgttttaatcttatgacaagggtctttacacagaacctgaaaaccttctttctcacacagagcacgagagatgatctcatcccaagtggcttcatggtcaagaggaactataggctctatgtggtcaatagccatatcctttacagggtggtcagaaccacacatggcacacttaaagtgcattgccagtctgcctgtctttggattaatcttctgctctgtcttggcgtctgctagtgcatcgaacatgggcttccattttctagtcagagaacgaatccctgacttgatgaaagagttataacgagcttcagtccacattccactacagcgagtcttctcagacttcgccataatcagcttcttcccaaactcgtttgtttacacgatggctcactttgccctcacgaggaatacgaccagttcgctgatcaaacagttgatgtttaatcttttgatctttacgagattcacgattggatgagttttcatcatatgaacgataatcaaatttacccattataatatccttattttatacagtctctttctatataggaggttgagagcttacgtctctctgcttcagtggagaagatgactactacacttcctttagtgttaccactaacactttgctgtgtatctgctcttgtgaaactcacacgaccacctgttatgaaaacaatctcatcagcatggtttatacacttagtaaaccacttaacagaagtatcagctggtagtaataaaactgtaccaactttaagtttcttgtttttgattgccaagtcaacccaaggagttatatctgaatatggaggattacaccaagtgtaagtgtttctgaactcagagaaatcataggttagagaattcatttcctctgttatatatttttctagtagatgattcttgtcactagatgctatatcacaggagaattcaaaccttgtgttaaagaaatcaaacagccatttaggagtttgccataaatctctaatgtcttctggggtattactagatctataatctgttaccattctctatccaaccatgtccaatcaaataaatcttccggagtctgaccaacaaagagcagcctagcattctcaagcatcttctcttcatcttcagtatcgaacttcttataatattccattcgtactatatgatacatggtccacttatctgtaacatcagctagtaatttagctgctgccttcttccctataccttgacgtcgaagctgaagtttaccaccccacataacctctttacgttccccacatccggggatattatctgtaccatctccaatcaacatctgatagaagaagttttgccatgaaactaaatcagatacatagtgaggaggaacttctttctgtctttctccacaagcccaacggtagtgccatccgggagttatcaacaaatccttgtctctagtacagatgatagtgttcttatccctacgttgcctttcagctagtgcatcatcagcctctctcccaaatacatctatgtattcatatttacctttaatataatcaccaacattttgccagtgaaaaggtctctctccgggaggtctatttgctttatagtcttgctgcttagcaacatcaaaacggaagttaccaccttcgctgaagtagaacacaaccttgctgcaacctgagcgagcaatgattgtatctatcttgtactgaagtcgttcaatcatgaaattgtaatcaactggaacacgtcctgtgtcaagaaagggatgctcctgagtaagagcacccacttcatatcgaagaacgtcagcatccactatagcaacttcagggagcttaacttcttccataaatatcatcctgagcttgtgcaataatccaatctagatctgatactgctgattcaatagttgagtcattaaacagtagatatgtttttctctgttcgccttcaatatatgagcgagagtctccatcaaaagagcaaccatctctaagaacttggacaacttggacatggaaattcttttctagttctcgtacctctgcatcaaaacctccgtcagtaaacacgacaatatcatcctgacctagcccttcttgtttgatgctttttacagcaagatcccccatatgattgttgccaaacataggttttaagaagtcttcacttgtagaaatcatcaaatctcttacagacttccctccccattctggtctaggtttttctttccattcacggtcttcatagcgtgctagaaagttttctagaggtatgcctagtgcagcagcagctaccttgtacattggctccttgaaggatttggttgaataattgtgatggtatgaatgggcattaacccaagcattggctatcgtatctttaccacaacccggaggcccattaagaattactactaaaggcttatagtgggaatctcccaccatattggtcagtgctggattgccttgagattccatttctaattgctccgtgtggtcatgtgagtaatctactggagaagttttgttaccagtaactttaggtaaaatcgctctagttgtttctacgtacctaccgccatcaacattgatttgaaactctacaagttcattctgtaattcataccctgataagttggatagctcctccaactcatctctgacgaaatttaaatgtttgattttaattgcaagagctttctttaaagcttttacctcttcattcattcccactctccagtgatttccatatcggctttatctcctttcttagtaaggaggattgctggtttattcttactcttcatatactcaaacatatgcatagagcctcttgactctccatcccagaagactatcactgcatctgcatactcacccatgtctacgtttcgaagtatcccagcctttttgccgagagtgttccacgaaggaatgaaacgtttgataggtatgtcattatgtttagcaacagtctctccgtgaagatctggacctcttgcaccacctgacacaacttctgaaatcagcttggggatttcctctggaagcaaagcccacatctgagtaaaagaatgccagtctatcgaccggcttcctgcgattattactttcatgtaatcaatccttgaaactcttctttatcgaagtgtttttctaccacatattcatacagatcttttaactccgcatatctacggtagaatgttccgtgtgacattccaatggttttctggatgtggtcatgcggtattcccaagaagatcatagagaacatattggctaacttctgagtatccatcgtatcacttaaatcttggaagaaatagaagatacgagactccatgaatgggtctccaacagaatcttgcttatccatagcaatctctaaaggactatcaaccatatcaggagtacggaacatatcagcctctggaattgagtagatacgacggtcccctacagtctgcctatttgaacgtatagaccagataatattcttgactcgataagtcatatgctcttggtctttctcatcctctaggactctctcatcctgcttagcgaagacaaatctccaagcattcaagagcacttcctgtgccacatcttctgcttcatggtaatccctgatatcgtacatgaagaacttgtgaaccactttccagttcactttataaaactcttcatagtttgagatatatttgattgggattccatgaattcgatatcttgtaggtgttgttttcttcgccatcatctttccttgttgttggctattatagacagatatagacaggtatgtccatctgatttagatatttaaacattataggtcttacctgagattggtaatctagtcccccattgccgcaaccaagaggtgttatggctagagaggtgattcccttatctttgtaggtaagtaatagcttttgtaaaccttgttctatccactctacctcagacccatttctccaatgtttcttggttggaaaacacagccccaatctcccatcatttaacctctgtaggagaagctgtccaatctggaatccagagttgcaagcaactttatacctctcaaaagcttcagggtatcttcttttatactccttagccactcctgcacccattacacctactaggtttactgtgcaggttactgtttggacgtccaccgtgaatacattggcttttccttcaaaaacaatagccattattttattccacgttctttcagagcttctaacaatccattgtgattggcagcacattctgtgtactggtcctgataccactccaacgtagtggctagtgcttttccttgagcactctctaaaagaggtaggtcaaccctacattcagcttttaggtttgttggtaagggcattgattgcctgctgttgtcgctcgttgaacaagctgacatactcatcactagcgcagacattataaaaaactggtttagttttctcataatgcatctctttataaacggtttccgtgttcttcttccagttagataaaccggtaagaactctctgagcaacttcatcagctgctctacttctttcaatctctaactcttgctggtgcttctctttgtccagattactgctgtctgtttgatattcgttaaacttcataccaccaaagaatacaagagctgagaaaacgataaaccctaagttatcacttaatgtgttttgcatgttgtctccaacgaaaaaagccacccggaggtggctaagctataacaaggagagttattagaatgggctatcgttgtcgtcttcgtaagtagaagcaggctctttatcaatcgtagggattgaaggagtagcttctttctgctctgtttcagaagcacgagtaatttcacgaccagccagaggcatgttcttagcgtcattagcttgagtaagcaggttgcgctggaacgggaacatcagttggtaggatgctacgttctcgtcggtttcagcatatggttcgaagaataccagaggactacgagcttcaccaactgctgcacgatatttggttgggattggagaaatggtcttgatggagtttttaacttcaccagctttgttagtataagagttaaccagaatgttaacaggctgacctaacagaacatccttgaaccaagatagatcacctttcagtgcttgaatacttgggtcaatcatcttgcaaagatcaagaataccagagttcttagctcgtgggtttacatcatagctcttgaactggcaagctggacgtggttctaatgccttaccatcggaatctttaccagtagcatcaacaccaatcagctcgaaagctaaatccatacggaaagccggattcttaggagtcactgctttggtcttcgggtcaatccaagggtcacgattgtgaacacccaaacctactacacgaacgatacgtgcttcgtactcaccatcagggattacatcgtagttggatttacgggaagcggttgcgatagttggaatcatagacatattttaatttccttatttaatttgaaagattgttgctctctttgagcggttatgtatagtatacattacgcttataccgataagagtactatataatataagtatctttggtagtagatatatcacactagtaatgtatatattgtatagctgataaagttattgcaggcttgtatattgggcaattcacagaatcccttgcaagtaccgaagggcaggagccacctgcgagataaaaatagagaattaaggaatccttgatttaggttgtagggactcctagggactttgattctctatttaaaagaatattaattacttattacctaaataattaactaacttacttaaaccaaattcaataagaatagataaaaagattattcctaagaaagctaaaaagtaaaggatataagttaccattcaagtaaacctttaaagttagatttttctactatcctctgataacgaagattagaatcagcttgtttctttaacatctcattatattgatctctgatagagtctttatgtactacaggttctttaaataacgagatcttgttcttttcttctttcatcaaagaccttcctaatctcttgcagagaaacagctttatagttaatttgctccattgatgtacagaaatatctccaatcatcaattacgtggttatgagtatgagcataaatattaaacttccctctcatctcatcagtgtgaataggaatatgagttacccaaaactctttatatttataatcaccagagattctacggaagactttcatcatatcagggagaagttctaacctgtcatggttccctaagactagatgcttctctcctcttacttcagcgatgatatcaagggcatacttttcaaacacccaatcaccggtaaagaagattttatcacgtttagttacatgatcaaatgcagctaggattgctttgtcatgttcttcgatggttttaaattgcttacgaaaactacagatgttgcgatggcctaagtgaccatcccctgcaaaataaacttcagccataaagacctcttagatagtacacccatcacaagttaagtcacctagcagggacagggaaagtaatctggattgctcatcgctgtatagttgatcaatctcttctttaagttttgccaactccataaagttaatgagctgaccatgttcgaggcagtctgtttttagtacgaacaaaacttcagcgttggttgagtcttcacttgagtatttatcaatgtattccatttttatgccacatctccttgtttgttgttaataacatccagtgctgtataagctttacctgttcctaagtattccaaaactggaggactcttcttttcttcagcgactacataaggtgtgatcttccctttcagtacagcctgagatgctttagcactgtcttcagaggtatgaatagtagtaagccctttctttccaattctataagtgtgaacccaaatcattcttcttcctcatattcccaatttctttcataatatccagagttatagtttagggcgcacttctcggcctcttctatgtcgtcggtgtttaggatattcacccaccctccagcttcatcaaaaccttcttcttcctcgttaatccatacactatatttcttcatcgaatcaccaaaggctcttcagagtacacaggagcggctatttctacaggaggtgctgccctaaggtcattaagtcttacgcccttcagcataccgtctaggtggtcctttttggggattccaacagggaagtcatcaatccagatatcgacgaagaagcctaactgtcgacacacctcatccttctgcacaccattacaaaagatgacagggatttgcagggtctctgcatcatagaggatatccacgttatcataaccattaggctctgagaaacggaaagtcacgaatcttacatcatgtccataccctttcatcaatcctatcacatctctccacagtcgtctgtctgctgtgtaagtgtcatcataatctaaaccaatattcatgtcaaaccctttagacaagaaaagccgcccgaaggcagcttcttatttaactgttcactttagcttcaagtgtttcgttttcaatactcaagtcaatcactacaccagtaagctcaacgactgcttggcgaagggcatctttacccatagagtgtacttgagataagaagaaagctttaccttcttcagtggatagggtttcttttaattcagaagcagtcattgatattccttatgttatgttataaattcgcatgattgtaccaccggttagttcaatttcggcaatcttctcatctcgttctaaatctgtatacactagcacattctcaaatacacctgttgcgtcagtataaaggatgttatacttcggaggtggcttacggtagataccttccatcactctttctcctctcgttctttccacagttcagcaagttctaaataaaactcagcttcatcaggacgtccttgttcattacagatggcgctctgacgataacaccaatccgatggcatctcttccacttcaatctccttgttacgaaccaatcaataagaatagttcattcatcttatttattcactctaccaatgcaggtacttctatccttttaactgtgaatgacttgtttggaaactttcgaactagctctgctgctttggttattgctaagttctctgtctcaaagatacacagttgaccatttaatgctacgagagtggagccaccgctgaagacggcccaagattcataataaccacgaacactcatcactcaacctcaatattatatagagttttcagtgtatctttaatccaagtaattcgtttttggttcttgtggtgtgatctgttatctctatctctgaaatattggtcacagccaaaagggtatgtatggtccgagaatttatcttggttaaacatattcttcatgtcatccacgtctagatgttttgtgaaataataatacttcttataacagcggaagttgaagcatagtccgtgatcttcattaaaccaaggaggacactcttctgtttgagttatatgataatactggaggaggaaatcttccatccctctctccttgaataaacacctaagtgttctatagattatattagtttctttcatcactcaccttagtgttttttataatcttcaggagttacttccctctcaaagattacattcatcatgaaatcatcagcatctttatgataatctattgtttcatatacaatgatttcaacagttctgtcatgaaacccgcattcatttttcgcccttcgtattgctgcctcttttgaatcttctatgtacagcttggagattccattcgaagtaaaaagagctatgtatttttgtctactttctgatatatcgaccatacctacctcaccttgtgctcttctgtttttacagatgattttgaccctgttatgatctcaccatccagaagtttcccaaaagttaaagactttttatctaataccaagtctacagggagtttccataagttatctttatatgagattattagctcatcgaaatcttcttttgtgtaagtcctgcatccatactctgtagattttccctgtattctgatttgtagataggttccaaacttcgttggattctctgtggctttcttaacttgaacctttattacttcagaccccttgcaagctatgaagtcacacttactctgtgacataaggggtgagtatacctcatacccctcctctacataatatatctgagcttttaactcagctattacaccagatttatgactatcattcatatgcagaattttctcttgtatatattttcaatgtgtatgcatccagttaagtccaatctgacaatcagaagccagagggcattccatgttcaaatactcaccagccttcttaacacaaagctcggtgtgctctttgagtttctgtacatcattacggttcactgagaattgaccttcatcgtgcatatcaattaccttagcacaacgaaccttatctttctcaatccacttgttaaggaacatcatagcatatttcataacaacagcaccagcacattgcaggagtgtgttaagggctttatgaaccataaccttaccagtggcatcccgtctcattgtaatcttacgaccatcaactccaatcaagtatccttgagcagctttctctgtcatacgatcaatgaggattgcaatacatgggttctctgctaagaaacgtgctcgcatcactgaaccttcgtcagccccaccacctacaattgaaccaagcttagcgtcaccagcaccatagttgaatgcgtagataaacgtcttagcgttgtcacgagtaggaagaccagcaagtttctggttgtgggagtggatatcaccttcaaggagaatatcacgatacataatagcagaagctaaaccacgttctgccagagctttcttagctggattgttctcttcgattgcctcagcaagcatatccctacactctttaatgaggtagtgagcgagcatacgaagttcaagcccagaaccatcataccctaagaatacttctttaccagcgggtatgtaatatttgtaagcacctacaggtttgtctttcttccccggtttacctttctcataaattacgttagtaccttttcgtatataacaaccatcaggaacaacgttagtaataacgaaaggacgagaatgatcactgtctgagttatagtcagactcaaacaaactgcgacactcgtgaccaaacaaaccacgggagggaatattaaccacgatacgatgtttgaatcgaaaagtcggcgtagcgcagctgttagcttctgccgaaagtttaccatcttcgcgttcctttgctatgagtccactgataagacctagcctgtgagccgctacaacgcgtctcttaagcaaacttccgacactccctagctcaccccctaacccttcttcaagagtctcctcgaggtttgtaggggctgtaggccacttgtttgatgtggctagtgctttcttaatctcatcaaacgttacaggattacggcgattagggtttaatcccaaaccaaatacgtaagccttcatataattcttagttttaaacctgaaatgcttttctaagaacttcttaatatcagcgtcaaccatctcggctgtctgcttctgcttagcattgcctcgcatccaagcagtataccatgcttggtacgttccatactttctcatatctttcttgatttcgaaagtattccaaggcttcttagatacgttaaactctggaggaagaaagccctcatccataagagcttctttaactcgtgcatctttcgatgggtcaaagtctacgtattcgacacaggtgaaagctccaccaatgtcttccctcttcagcccaaccctatcacaataggcttgaggccacttctgtaaagctccagacttcttaaacggcttcatataagtagagccatctaatctcatcttaggtaagagaggaatcagttctttgtcaatattaacaataatctctttaaggaggtgaacataccaccgagcatttcttcggttgaaactcactccgtgctttgcttgcttagagattatatcagcgacagtcatctctgtcaaaaatggaagagcgtccgggttgctcactttatactcctttaaattattggtaaagtaaatctgtaaatgcttggttatcttctactacattcagcatggttgcttcatcactataagccctaactgtcccgttgacaactgtccaaggagggggcggaggtggtgtatgtgtagctctggcttcacgaggttgttctcgtaccagatgagccacaaccctctgattagcaacttcttctctttctctaatagctctctgaatgtaggccagcttcataccccaagcttcttcaaactcttgagggtgtttatcactgataaccacatactgacgttcaggaataccagagcgaatctctgataataattcatggaacaaatctagttcatgttcagtgagattcatttcgatatcatcccacttgagaactaagaaacggttttggtgtctagctggtaatggcatcctactccacctctacttcaatgtaagttctctcaccgacgtcatcttttaagacccatgacttggcatcttcttcagacttaaaagctttcacaacgctgtaaccaccttcccattcatcaccgaaccagcgctgtcctacgtaaatgtattctttcattactcaaccttttgggaatggcatcaaaaattccatagcagatttaatctcattattgattcgtgaatcacgataagagataaacttacctttgctatcacgtaacatcacatgggttctggctgttttgtgagggagcaatgtgatactagttggaatagcatcaatccctacagcgtatttgtcaatagtcttactttcagccaacagataagaccaagtacgcggtttctgctccgggcggttagggtatgtgtcccgaatttgaaccatagctaacttattcatattaaactcctttagggaatgggatgagattttctactgcaacacggaaagatttttctacgttcttattcttataagagataaattttccatcagctcctcgaaggagtacgttagtgcgagctgtatttgggttttgttgaatcatagaacgaatgatgttctctgaacctctatgcttattggtgaatttccaactgatagttttaccggtacgagttacatcaatgatatttacgatttttacaatagacatatttattacctaagaagtttaatttggtttatataaaagaaaaggccacctgattaggcagcctttgttctagagacgaagccaagtttgatagtcagcttcagtgtaatggttgtttcgagagttgtttttcatttccttgagagtagctctcaggtcaatgttatgctctctccttgttctattcgggtctgtatcttctaatagatgggagtgatcactacaagagtagtgcttatagtggtccctgtatcctctacttggagaatacttggtcattaaagttgcaactctttttacaccctctgctttacagaatttacaataagtgtgaattgtacatctttttgtttctgctgacactataacctctttatgagcttaaagctcctttgcgtgctccagctgcttttccagctcgatcaccacttttgccgccgtttgaacggtttgagctgactgattcaacacgtaagttgcttgacgcattagagcctccagacttgacagctcgtttgtgtccaacgtctttacctctgacagcagcttttccatcgcgcttttcaacgatgcgacgtgcacggtggcgctgagcatctccgctcttgctcccaacgcctgtttcaccacgggcaattgcggtacgtctttcttgtgcataatctctctttcctacatgatctgccatttaaaactccttaatatatcagtgtacactaaggagtatacattataagttactgtttaagctttcttttccattgctttaacaatcgccttacagaaaccagaacgaacaatatcatctgattcaccatctacaatctcagcaaactcatacagatcgtgttcatcaataaagttagtagcccaagttagaccactctcgcgaccacgcatatcatgctggtttgtatcacccatacagaacaattgagaggtttctcccaatcgagtcatgatggagaaggcttcatccttagttgtgttctggaactcatcaacaataacaatagcatcattgaaagaacgaccacggagatattccagaggtacaaactcaatgttaccatttccgatttggcattcatagaatcccttaccatatcgctgagtaataacatcaatgataggcatcaggtaaggttcaaacttctcacgcattcctcccggaagtaacccaagagagttgcccatgccgacagaagggcgactcagaatgatcttctgaatcttaccgctcttcagtgcatcaataactgtggaagtgattacaaaggtcttaccacagcccgcaggagcgtctgtgaacacaacttgtttagtcttaatagcattgagtagctcagactgaaactggttctgagggactacaggctttgctaaaaccacctcttcatactctcgcttacctttacgagtaacaagtgcttcccgacgaaggtctttccgtgattctttccgtgattgacgacgactcatttacgctctccaatttcttcgtaatgacactcagtagttaagcagtctttacagattgctgtataaaccctgacgttagtaaatcgtttgttcttccctttggttggagagcctttggcaagctctctgataaccttgttacttaaatgaaggtttgttccttcacatttagagcacttcatggttcatatctttatgaatcctgtaaacagctgtcgccatacaagcaacagcctcgttgtgtgggaggtgcatccctgtagaaccatcccaatctttgaactcattgtcaaagactccggtaggctctggatatagagcttgcagctccactagatcattagcaacttgttgccatttatcatcagaccagatagggtcatccaaccagtaatacaaataggaatggatgatcaattgccttctatgccgattgattacttcagcgggacttatctcacttccatttgaagtcctaaatgtattactgtcaatcatttcacaaccttaaatttgaatgttgttgggtgataataatgcaacctattgatagtgtgctttgtttcgagatatatcctgcaagagtggcacatgacatgggtcagaccagttacagggttaggtttgaagttggcgacaggcttctctttcttacagaagctacagactttcttttccatcttttctccagtggtcaacgaattgctgaaacaccttatggtcgaatgtgaaaccacgagcaatcccacactctacgaaagtagaaggcatatagtctacatcatctttagatgtatgaccataaacttgaataagctttttaatcttatccttctctcttcgaggaagcatcctaaatgcctcctgaatatctgtaatatgtttgattttcatcagaaagcctctgatattaactctccaaagttttcttcagagctgcccatgagattgggtagagcttagccatctcttcgtctacagatttagcaaacactcgaacttcatattgagcgtgagaggagagtcgctgacgacacaactcaaaccagccatacaaagaaccggtccacacccactcagtgatcatcccctgaggaagaacaaatcgagcttgctctggtgcaataaattcaatcaacttgtcatatgctgctagagaagcttcatatgcatcgttaatcagcattaatgcttcagctctctctccgtcgatgagttgaatccctgaacctgcatggaggtccgaaggtctcgcaaaaatctctttagggatgaagacttcaactgctccatctttataccgccgggacatttcgttccacgagaatccaacctgatgcttgcccaactgtctcgcaattgcaataggtgctttgcatcggaaactgacttgcgggtgtcggaatggggtaacatgcttctctcttgcgaggaagttgatgagacgttcatcacgttcatttaaatcaccttcacgggttacgccaaaggaaactcgagctgcgtttactacgctacgatcacttcccatagcttcgattaatgttgcttgtagttgttcattcatccgtgaatatccttattacttattgctcagggctgtgtccaaaaatgctttcaggtttgcttcagtctgcataccagagaggctatagtgtgcaccactgttacggtcaggcacaacgaaagcagggatacttcgtacaccatacttaacagcttgctcacgaccatcaccttcaaggatgttaatctcttccacttctacatcaaactccttaacaaccttctcaaaggtaggagccattgctttacatggagcacactgatcactataaaacttaattactttactcattctattccttgttaataaacaggttgatatgacgctgggtagcaggaacaacaataaaagatttatactgaccttttgctaggtcatgagcaatcttctttgtctgaccaagacccatcacacagccactaacgataatggcatgtgcttgtaattcttcaggtaggtttagtttcactctttggattccttatagcatacaaagaataataacaagaggtagtgttatagcaaaatgtaccagaacaacactacctagcttgatagctttaacatcctcttctgctgggttttctttaattgctaaatttcgagctttatatataacagtaccaactattaacgaccacacggcccacacaatcagtgaaatcatatcaaatccttatgcagtcaggaggtgaagcaggaatgggataacaacagctacgataaccatgatagttgatgctgtttgaatctcacctttcttatcaggggtttcttcaataagcttaccagaagcccaataaataccaccaccaataaagatagcccaaataccccatacgattgctgataacatatatctatatccttataaataagttcgccccacctcgggttaggagacagggcggaggttttagtaagacacgtcaccacttgaatgggacatgttgctcttgacgaagtagcaatacttgccaagaccttcattaatttcttgaagcatactctgatcaacagggtaggtggctaaatcaccatcaaactcatccatcttctcaataatacacatcaaggtcatgcacatatcagagagcataccgtccatatctaggtcagcattaccctctgagaaccaagcatgagaaagatagttagctgctgtagcgtccactttaacgcagtggtaacgcatacgttcagcaatacgatctcctacctgtcgtgcgtaatcttccagctcatcaaacataccatgaacaccctgaaatcctgcaccagagacgttccagtggtagtttttagctttgatatgcaagagttccatgttagcttgtaagcagctcaggatgtgttctaggctgtttgcactaatcatgccttgcattgtttcaaggcgagagattgaaagatcagaccggtctaacatgctatagctgtcacgaccaatctcaggtaaatcaaagacattcttatgcatttgggttttctccatcaagttcaactgagttagcaacgttacgtgcaatattatccattacctgctgggtaattacgatgcagttctgtgggtctactgacttagaacgccccatttcagggtcatacaccttaactcgcttagcagttgaacctgtaacctgaagaaccttcaacagatatccctgattaccaatagaccaagcaacaacatcacgattcttgataaagcgaccaagcatatcacgatgataaaactgttgcatcaccttggattttgtaatctcttcagtgggcggggccactttactcaaatctaacataactctctcctgtaaaatacaaattcttattgtactctatatacatttgagagttaccatatctactaccaatcagtagtaaattactttagacataaaagaaccagtgttagggtcttcataccagcgatgtatgtcagcgctttttactattgtgcccagagtcttcaactgtttcttagcaatacgagcctctttgcgagtatcaaacaatttgatgttatcttttctcatgtgttgctcaagatcccaaacaacatgaatagcccacatctttttcattagtaatgtacctttccgctgatataaacacgaccagaagaatactccttggccttatggatgctgatactgttgaccacgtcaccagtaagcatagtctttttaaaatctcgagcttgttggcgagtgggtagtgcagtcatagtcataccacctgatgcccacttaatctttgctaaccaaaattgtctcatggtgatcggtctcattaataataaaccttactgttggcaaaaaaagcaccttcgctattcacaatagcttttccaattgtaaccttgttaagtctaaaagtagacttgtattgatttttgaccctacgtgcgtgttctcgagtcttaacaaaatctacagctactaactctccagtcgtgttatcatgtacacgaacaatccactttttcatttacacacctttagatgcaaccacaccttcagagttattataacgacccttcactgcgtaggaatgttcccctgcatgagagtgctcaaacataaccatctgaccaacacgcataccagcacgaactcgtaagctgtggtgcttggttacgttatggaattcaaatgtcagcttactactattaaatcctgcatctgcccaaccggcgtgaaggtggttcaaaccacaacgagccatagacgaacgcagaacaaacagacttgagatgttatctggaagattaaactcctccatagagtgagccaagaagaactgacccggagtgataaccaaaccctcttcaggaatctttacttccttccactgaagattctctttcgcatcaatatcaacgatgccatcagcctgttcttcaacaaggatagtatcaccaatacggatatccacactagcagcgttaacatacttatgctccgcatccagatagccattgtcaattacatcatgcagttcaatacttcctagtaaactcattcttattccttagttatttgtttccatgtcaaaagagattccacgacccgcttcatcggcaaaccgaactgtacgggtttgaggttctaatacttcagggttgttagcaataaagcgatcagcgagactatctcctaaatcttgttccataccttcatcagtccagataacacgagaaggggcgttgatatcaccaacagcaaaaccctgaccagagaactgacgtgcgctaacagttaagccgtttggtcgaccacgagaaggactagccatccatctctccatagaatcacttgtgataccaagagcttcttcaaaagatgttctacgagtagggcttactcttcgtgactcttgtgctcgacgcattgcaggggctacaaacaccccttcaattgcattgtgtcggttaggctcctcttctcgaccaagcagatcaccacccgtgttagtcattaggtttgttaacccttcagaccaatacgcacgaatctgaccagacccgtgaacgcttgacattaacagaatctcttcataagggattccaaagaatagactcatgtctcggttaacacaatattgagcacttgttgtatcctcaataagagcaacctgacctcgttcgttgactagttggctaactggttgaggtgtgggaagatatcgagtttgggccatgtattgatgagcaaccgacggagatgaaaacctcaatacctgagaattgggccacttcttgtggacatatcggatttcacgactagaaacaaccactggacaaggggcggtcatagccaaatacccatggttggtcatgaacaagttatcaatagtcatcgcaccacggcacatcatagggaaattatccaacacctcttcaatagaagtaggatagttaaacatgaattgaatgcgggttccattccactgaaattcaataatatcagtgaatgttaattgagaactcccagcataggactcgtttgtagcctcagcaagaagagatgaatactcaatatcttgtgactcaagccattccttcacgttactttcaatctcccgtccaagcatttgccatcgctcagttgggacgaaagtattttgagttcttggtgtttgtcctctgacaataaagatatcaatgtcatgtggggctatattattaagcacagcatcacgaatagccccaccagtaatgataggacaaataccgtctggaatcaagttgttgtcaattaattgttcaatgaagtgacgaccaacagtaatatcgggttgttgagcaaccttatcttcaattcggttaatcgggataacaatcattttacattttccaatataatgaaggtgggtcgtaagggtcaaatcccgtgagttcacacaagaaaagataaaccttaacagttaagttaacgtcctgttcacaataagtaaacatatcttcagtgaaagcatcccatgcttcctcttgctcaccgtagtcacctttaagttcccctaagaactcaccccattgcttcaagccgtgacctcttgggccacgtctagggtcgcctttcggatactcaggactgtcaccaatacgatcaggtttaagatatcgactaagacataaagtgtcaaagacgttaaaattatatttaatcaaagaaggatacatctttttcagagcaggtaagtcgaagtcaataatattatgacccactagtacatctgcttctgtaagtttacgaatcccgtcttcaatttggtgaggccgatagccccacctttcaccagtttcaacatcaaagatataaatacaccatactttagttatgtcatcgtatagtgcattactctcgatatcgaatgcaaacactttattctttttctttaccacggtgaagctccatctgcttggttgacgagagaagctgcatcctctccgttagttaaaacgaatggattatcttcatcaacttcaaaatcttccctttctacaagtctaccggtttcactgatatacttagtataacagacacctgtctgaccgtagttacgttctttcagtaatcgaatgactgagaggttcttagctaagccgtcagcttgcttgtcacgctcaaagccaatgatacactgacaccaacgcataagagaacgagagccagtgaactgtacttcacgtacctgtccaccttcttcatgaggagcaccacctgccggagcattaaggtgagatagcacgaaagcggtaaagtctaattctttacacataccagcaagctcggaagcaatcttactgatttcagtgttaatctctgaaggtgttaaatgagataccagagcggtaatgttatcaaggatgatgaacttacactggttttcaactacccagaaacggatacactgtttaatgtcttcccattcattctgtccgaagttgtcatacaagaagaatttgtctgcataacgaagtgcttcattacgcaaatcttcctcgtcatattcaacatcaggtcggtggaaaggaatcgatgctgacttaccagcgatgttcttaacagacatgcctaccttctcttccaagaagaagccacccccattaaaaccgtgctctaagcacagatgagcaaccagctcgtgagcaatgagtgttttaccactccctactccaccaccaattgctaccacctctccccatcgaataccgaaggtcatctcattaagagttttccacggatagggaataccccactccgctttcttcagagcatcatcaaggcaatcaaagattgttacagcaccagcaggagattcccgctttgctgaatacttgagaatgttgaataactcttgaccacgaccagacagaagcatgtcattcgcatccttaatctctttctccacaccgttgtatgggaaagttcctttaggaatacgagcaaacttaacatgagggaataaagaacgaccttttgttaaagctatctcacctgcatcatcgttgtccatgcagagcacaacctcctcaaaaccatttacgaagtctcgattacgagacaacacagaagagattgaacctgcaccgaacggtaaagaaacacatgctggtttaatgtttgttgcatttgtaaaagctgtaaggacgtggaaacctgacatacaggatagcgggtcttcaaaaatgaagagcttcttgttgtacacatctccacgttgagcttgtgccataccaaataggtctgcctctttcacactgccgacgtaatagaacttcttactatctagcagcttcacctcatacccgacaatgtttccatcacgttcacgaggaaagaagtaactgtctggtgtctgaccatcagtttgactgaggccaatacgacactcaaaccgctctgatacagctttagggattaaacggcgagtaagttcaccctgaggaagctctaagcaatcatctaagacttctctcaactcttcaggggataactctttcttctcgtttggagtaggtgtagtgcccttttcgaacacttcgtaattcccacaacggttacaacttccccactcctcaccagtctcttcgttacggaagagaatcatgtggttgtgggttttatcacgaccatgagagatacattccttacaacctgtgtctcccaaaatgatctttgacatgctcttcctccttggaatccttgagcttagtagaacgaacgaatttcatcccacacttgttcctgttctttcctataaaaagaaagttgggtcttgaacatctccactgatgattcaaagtttttggtttgtgcagcttcaacgaaacgttcatgtcggttgattttgcaccgtagcattaaatacttggcttcaagtctccgaagagcctgccttttctcaagattcacttttcagatactctgaccagtcgccagattcaactagaacatcttgttcttcgtcgatatgataaatccaagcgataacagtttcacctgagtccatcttaacagcaatctgagtacgctgatagaagctgtcttcagggctacgtttgttgtaaccttccagacggtcatacggaccttccagacctgctttgtcagtagcaaacacttctacacgaacaggcttgttgttattgctgtgtgcgagagagatgctcgggaagtaggaaccaccgtaacggaacagatcaaagttgtcttcagtccaaccttcaccaattgacttagcaccagctcggtcattaactaaatagttagcttgaccacgacgaagagaaccataagttgctacgtaaattacttctgacattatctatacctttgttggtttgtttagtttatccgaactagcctcctctttcgaagaggctaaagcagattactctgtaataaagattttgattacaccacagattgctgcactttcaaatactgcaacagcttcacttccctgaaagaaggccactttgccatcagagaagttaaacatgtcagcatctaggtccatagctcgcatatcaccagcatcattagtatctttaaacagaactttatacttattcacagataggtcactcctttgtcttgttgtgcttcagtgatgatacgttctacacattccatagaatacttatcaccacgtttcaggaaagttacaattgcagagaattgattaccaatcattcgctgattagtaataccccactcctcacacaacttacgcaactctttacgagagcctacaatcagaggctctttttgttccatcattccattttgtactagatcttccaatgaaaacatatccatatatccttagtagtttacaacagtgccatcattcagggtaagactgttaatctgcaacacacgaccaagctggcgatcaccaatcggtgcattccacccagagcggtagaagttacgaccacagaagaacaagatcacattacttgctacagttgaaccattctcaggatgcttgatgttagcgatataataaccacgacgcagattacgacgggttaccgggttgatctctaacccttgttcttcaacttgcattgtttcaggaacaggttccgaagactcttcagcaactggctcagctgccaatgcagagttttcgtcatctgccgattcagcaaattcttcttccacttcttcaacaggcagttcgtaagcaacgcggtagtcaggatcaacaccagagaagctcttaacaaactcaacaatattgtgagtgtaagtttccagagttgttccagtcagtcccggagctgtgttaacttccagaacccaagcgttagtatttttactaatcaggtcaacagcaccgaagttcaaacccagagcagatacagctttgtgggcttgaatcagaacctgatcaggcggcgcatcttggaagtttgaggaataaacccaaccagtatgatggtttcgaacgtcttcacgataggaaggatcttcacgataaccattacggcgaatctttttctgaacataggtgataacaccttcaaacacatgaacacgccattcacgacgtgggcctagaatgccacgggtatagagaggggcgggagctacaccttcaccctgaagacgaacagtgatgccttctccagaatgaccattcagaatagcacgttcataaacaacactatccagagtccactctgaagcctgagcagcactgtttgtgtattctacagtatgtaccccagcagcttccaaagtttgaaatgctgtcattttgttagcggctcggttcaaggcaaccacagagttcaatacagttgcaccgccaaagaaagaatcattatatcgacggtttccgtagttgacaacaatatcaccaactcgagaacgataacgagaaccctctgataccagagacattacgttagcatttagtcgaagttcctgaatcttagtgttaattgcagaagtaagttcacgaactgaatcagaagggccataaggaagaacacggatacgagtagtcattgttagatacctttaagtttaagaatttcgttacgagttttttgaatctgagcttcaatttcgaagtagtcattgaacgcatcgttctctacttcatcggatggtgcatcaatcagaccgaaagcgaacggatacagctttcgctgctccgttactaattcgatatgaactcctatgtaatactgtaggagagtaatcttcggtttcttaggaaccagatttgacatgaggttctaccttaatgcctttgatttttacataatcagcaagcacgttgttgatcaccgttgggaaaggaacctcaacctgtgtttcaagtacttgaccaataccagcttgcatccacttttggattgcacgaaggttatcacatcctgtgctcgtcatcgggatacgtcgagtagttacaacgttatccagcatcatcttacgaatttccatacttaacctctattcaatgaacatttaggagaattacaataaacttgattcatagaaccaagcgtacaactttcagcatcgcgccacggaatctgcttaaaacactctgagcagtagccgagggttgaccacattgctttggtgaagtcagtgcttcggtttccgtcgaagctgacgacagttttgcggagagctgttcgtgattcaggaaacacacctgctttctcagcaggttcctccttttttggcttagttgagattgcaaaaatactgttgctacgtttctcaacataagcatcaacaacatcctccagagtgatgcctgtctgtttcgctgaggaaggtaatacagtcatacgaccgatcatatcttcagttacacgtaaagcgaattcaggacgacgggcgtttgttgtatctgttgctttaatccagacataaccatctttgatcgtagcattagacactttcttctttacttctacagcgcagactttacagatatcttcaccacgaagacgactaagttcatcatcgaactcattctctgttttaacttcaccgcagatttcacaaacaccaataggagtttcctcctcttcttcctctttaggtttagtcaaaccttccagacattcaggatgccaatagcactgatatgcgaagactgctttaggtgcatccttccaatcaatgtgcttatcacaaccaccacaatcaccatgagagtgcgcttcccagaatttacgagtgatagtaacaccattcttgttgacgaaactatcattcatatcaaaagggatatcatcatcgaagtcagcagtagttgactcaggctcctttttctccagagatgggtcaacaaaacgacctgctgtgatcactaaacggaccatagcattgacttcggagatgcaggatactgtcccacggtaaacaattttagggtctttcagggcatcctgataagccttaatgtctacgttatgaacatcaccttcgatatactcttgagatttctcatcgtagatataaccaatcatcttaccacgagaaggaacagcaccggcagttgcataaggaacaaactcatgcggagtgatttccacagtcatatcgcggcgaatatcaatgtttcgatcgcttgcgattttgttttgacttaccactgcgtttcttcgacgaacgtctgccgctgtcacacccggcttcgtgtcgtaaggattgcttgtactgctttttgaggaactttgatagttgctttggctgtaattgttcgagtagtaattgccccaacgattgactaccgtaaaaaccggaagctcgtgggcgacctcttcaaccagtgtcatgctgttattagacatgtcaaagatatactctgtaccaactttacactcaaaatgctcatcaatacggttcttgtgagacttcgaacgcttcagaatccacatcagcatatcttcttcagaagcgccaaaccaatctctgttacaacgtgcgagatggaaaggacgctcttcgttacgaatgatatgaaggcggttatcagaagcatcatgccagattaaggtgaaagcaccatccagcttttgaatagtctctgctgcaccaatagtgttaatagagtggcagatgttctcactatctacctcgaagtttttactgtcaggtaacaggtcttggtccatcaaggttccattatgaaccagagtgatgttaccatgttggaaaggatgggcgttcttggcgttaactgcacctttcgttgcatgacggctgtgaccaacaatccatgaaggcgctacagtgtacgctgtttcaccagtggtatgcttcttgtactcatcttgtaggatgaatgcgaaagaaggaagagcttctttataagtgaagacttccttagtgcttttacgctgaccaaagatacctgaggaatgttgtcctcggaatactccagcataaaagagttggttgaatacgtctaaatcagtgcttgacagattaccgccagctaatacgatgccacaaattttctaatccacctgaagggtaaaccctttcatctaattaacctttaaattgtgcccctttgtcagaggcacccattgattacagcgcttgctctaactgattttccagatggtctggaatgtaccctgtgatattgctatcactgtgaccagactcacgtagtaagtcaaaaatagcacggatacgttgttctggagcgtgtcttacttgagatagatctgctgtacgaagcataaccaaaatctcttgatacaagttgttagcgttccctcggacatacccaaggaagccatagaagtctgacataagacgtaagtcaacaagagcctctccgttggagttggttcgacgtaaacgaatacgaccagactgttctacttcatgagaacggcaatacaaaacatcacgggccatacaatatcctgaatgcaaatcagattcatccagattgtaatccagaggaaggtaaggaagcattggggcaaatcgtacagtatttaagtgctcaataaactgatcattgctcatatctgcgttatctaaagccagcttcttcaacatcaagaagcggttaaccagattgagaagttgaccacgtttccacttaggctcactgatacggaactcaattgaaccgtattgggcaagtggcagaaggttcagagatgtatatttatcccatgaacgaaccagacggttgaagaattcttcaccatcgtagttaaatgcgtcagaggcattcattacctgtgcttgtaccactgcaaacgcagggcagaaattgctacggtaacgatggtagcctgaacacttgaacagcatcttttcatagaaggtccaagcaaggatggtcttcttgaggatattactatcagcatccctcatatccatatgaacgtgagtagagcaacgccaagtcccctcggcgtgcgattcagctactgcttcactcaggttgttgatagcgtctaacaactcctgtccgttgtaaggtcgtgaacataccatttcacaaccgttacgcagggaaccatcctctgtgcaatcccacatatctgcttcgatatgttcagaaccttcgagttcaagttcaataccgacaccgcactgaagtgcaattgaactatgcgcctcagttaaacgaccttctcgatatccaaaagtttgcgctacagttgtcataacgaatccaccaacgtaatattataattgctaaggttttcagagatgtgatgaaaatgttccagaagtcgcatcggttgttgaccgtaagagtcacgaggcgcttccagatctacctgacctaccagtgcacctttataatgcactttaccatctgtaggattgatgtaaatataacgagtaaccaatccatcaaattcaggattgaacagactgtaaaccatttcaccagagatcgaacgaccaatccccggagcgtttcgaatcttgttacccatcaaacccttcgctctctgacgaacaggattgatatgagtccagcttacagtgttaccgttatggaacagataaccaacatcaggtgattcaagaatcaaggttgggtcgaacactggaatattcatcgtagtgtttcggagattcccatgctcattcttgtaccactgctctacaacaaaatacagagcctgttctgcttcatgcgagaagtcatcgctgcggaagttaccgctctgctcaacaccaatcacaaaacacggaaggttgatattgcctgctcgtttagcaatccatgtaccattatagtaatgagaaaaatcagctactaagctcacgataacctcttatgctacctgaaggagtttgatctgctggtcagcttctttaacgttgttcccgttaatgatttcatgaagcttctcaatcggaaggcgagagtgcaatgccatcagagtggacatatcacactgctgaacaaccttgtcaacctgatcgtaaacaaacttacggttttcacgatcactaatccagaagttagacagagagcggtattcaataccatagtctttataacggattgcagatgctttaccgtagagttctttacggcgagtatctttgtccataattactgctgggagagacaggaagtagtcacacaacacacccagcatcatctgagtttgcagagtgatatccaaagcaccaactacgccaagatgtacgtgaccaccggcagtacgaagtcccttattctgagaagtcggggatgggtttttctgaccagtgaaggcgttgaaatcaggagtgcacccgaagatgaacgctgattcgttaaaggtcttcatctcttcttcagtgaagatgtgagagctaacacccggagctgtttccatgtccagtttgttcaggacattattggtgagatcaataccacgttgcatgttatcgttaaacgcttcaaaaccgctctgtgggtcaatatcaaactcagccagtacgttgtcctcttggagacgaacatccttagccagagcgatcttatcgtccttagagcagcctaataaaccggctacagaagtgatgataccattactagtacgaacgaacatttcagggtcagagccgatgaggaatttgcgcttagtcattgtaatactccactagttcagaaaagagagatgagattgtgttaccaacttcttcaagagtaagaccggaatctgctccagttctttgaatcagtcgggatgtaaagttttgtaccgtaatgtttcccaacttgtcgtctattgcttcacgtttgtgaccataacagttggaccagagtcttaaccactctgacattgtttcatactcgtctgggtcttgatctttagcacgagcaaatcttcgtaaggcatcttggttgtggttacgaacataaccattctcattgtcgccaacaccgaaggggttttgaacccatacttgcttcgtatattcatcagagtctacaaccaaaggaaggaaagctgctgctgacatattgttgttaataacaatagaggtgctctcgctactcccattggctcttcctcgttgagaccacccaccgaagaagtcacgacccaacccagctaacactagagcgatgccgatgcgtttacgcttcagccactcttccctgtcttcaattccttctgctaggaaatccattccacgatattgcccttccagaatactacggaagagcataagtcctgtgaagatctgatctgctggatgctcacgaagattgacagcaacactgttcgctgaagtgatagtaaatacatcacgatagcaagacatagaattcataatgtctgctgtttcaatcaagttcttttcaatatcagatggaacatgaccatgaaaagagtgggtccagtaattcaacatctccaattgcaagttaatgtcacggttgaagcgtttatggcgcccatcttccattacacattcgtcattaacatcatatacgacttgaccttgcatgtagttgtggataccgaagcacccacgacctaagaacttctgttcccctaaatcctgttgaagattaagaggtacgatcgttgtggagattgacataactaaccttttattttcctaaaaataatccgctcataataccatcccactcagaggacggaatcactgaatactccgaactttggtccagagttccactactaaatcgctgaatgatgttgtagatgttgaacaggtctttagcctcggcacgaatgccgtagattaacctgttagctgttttctcatttttagacacgcgacgggtaaagttaaccaaaagattatcacctttaagtgtctctgacccgtcttttactagatcggggtgcatcactggcaagaacattgagttgttaactcgtaattctgctgtttcatcattctcgtaatgaatccacttaaagtcttcatcacggaaatgaccgcatccatctctatatgactgttgacgccaaggcacttgaaatgcttcagcgtatttattagccatgccaactgtaaacagcgacgctgggaagatacaagcatcccaatcattaccaaccagagttgcttttgtttcccctaagaggttagtgtaagtgctaaccattcgcgagtaaacataagcctgaaggattgtccagccttcaaccaaccatttatggaggaaggtttcaacttgactctcttcatcttcacaatagaagattcggtctaacatcaaatagaacagacaacgatcagcagggatattctcagttgctacccccataaaacctttatcgtgccagcgtaaacaggagggacgatctttgtccacaaatgcttccatagcttccagtacagcacgaggtgtggttcgatgctcagggtttttgtcgttccaacgttcgatgttgttcttagggggcgtgtcttcatcttcatacgaacaccaacttaaagcttcagctacatgcttttcatcacgccaacgtctaaaacctaacatcttcatatgagttccagagttccagatatgcttgattttacacatatccatctctcggcttaacaggaactcttccccatcagcactacgaacgttagcttcttcatgccacactcgaacgtgcatattccatccatgagttgcctcatacatgttagggtcgaagtagtcatcatactcttcatcgtcttcatcaacgccaccgttatagttgcgaagctgaaggaacccataacaaggagggttgactgttaaaacattaccttcagtatcttctaatgttactggaaacattataccaacctctattggtttttaatcaactcaatcgacttacgaatataaagaatatctcggaagtttcgatagttgttcataaattgatgcttctggaactcagcttcttccagagctttctttgcttctgcgtagtttttacgggcaagatgtacaacccgctccggtaacacgtttgcacgatggattagatacttatgagctttcatgttactttgctcacgagcaatcttacctttagcaaccttgataccatttgcaatccaagcaagttcttgctcaagctcttcgttggacataccaccgaggtttgatgcaaccttgttcagagtttcaatattaacgttgcccttgatgggacgtgtattcatacttactcctgttgtttacactcgtcaataacccactgataagtggattgcccagaaaagaaacactgaataaatccagatgttctctgcgttaccagtgctagtgcacaaatcactaccgctgctgctagcagttttaaatctaatttagacatatttcctctctttgaatttaaaaaaggactctccgaaaagagtcaagctttaaatacaaaaagatattacccaatatctgtggataacctgctcttaaaatatctatccgacggatgttcgaggaatgttcctctccctagcatcggccccatacgggaaatatattaagattaggttagttgagtcagaataactcacatagccctccgaagaaggctatagatgttactctatcttaactgaagggcagtatttctctttcttgctgcggtacatcacaacaaaccagtttgaatcacgacgttgctttttaagtcgtttcttttcggcacgaattccgtatgtgctatctcggcgatctaggaatttatcccgcgccttagttgaaagccacgttgtaccaattatgaaaccgactaggcttccagcagcgcctaaaccaaccataggagcagcaaaccaagtccaccatacaaacgtacctgctgtatcatgtcctagcagtgcaccaccaataagacataacgctacatataccatagcggatagcactattaatacagcaaagttttgcactgttcgccagaagtattcacagaagttggtcatgttgtcccaatgataattgggtaggcttgacatggctttgttgaatttgtgcaaccagccgttcttgttaacctttatcatcattcgcctttcttagcacgatctttggcagttttgccagtgcggatgcgatgggaaacgttaaccagagtgccaccatcaaccacggtaacgctcttgtttttagccagatcgaacacagttttctccgtgccacccaagcgaatttgcttaggttcgctgaaggtttgggttgatttggattggaactggaacggttgacggattgcatcaattgcacttactttagacataggggaaattccttaaaaagtcatggctgcgtagagggaattccctacgcaaattgggccgcccacagagaggcgtcatagtactaaaaggaggagagaagagggcttatttagctacctttttctgtccgtttacaaaccagataattgaaccatcaggctgtcgttgaccgaagcctttctggttaatcatatcgtcataagaatatgctttacgtctcatttgttttcctacgaagttaggatgatttcagccttaatatacttctcaccaacaaccatatcaccagagatgacacgtagttctccagtgcctaggttaacagctccagcaggttgacaacccctgcttttagctgtcatcatataaaccttttgattctggcactcttggagagtgaacacatctgacatatttagatctctgacacggaggattttttcctctttgtctttaactttaatgttaataatgctcatatgcactactcctgaaccactgacatacgaatcatttctacctgatcatcaagacctttaacagataacacacctgtggaaaggtttaccacaggaacccaaccactggctatacggatgttaccagaagcattttcaaccctcatgtaatactgaggagaggcacttccgttctgaaccacgaaagggtttccgggaatgattgtttccaatcgtaccgtattatcctttttctttgggatgattttcattgcgtattatccaccaaaagttctgctgatacaggaacaacctgacaacgaccaagaggggctgaaacaaccccatcacctagccggagagtaggtatccggttatctgggattttgatgttaggacttaaggtaacaacccctttcacataaagatcttcattgtgtgggaatttaaacacagaaccattagctagagagcttagctctactgcttctacttcctctttcttatatgtgattttcatattgattcctatttaagtttgaggctaatgttaaggtgcatacatgccctgttctgtacagcagcataacttctaccgagcatgtcagccattctctgaatagacatgaacccagcattacggataaggaactgatcttcttcttcagaccacttaactcggattgaggctcttgatattccgaatttagtacaagctgtgttaactgcattctccgttacattcataatctgagcaacttcttgaaccgagtactctttgattagtctccgaagattttcaatctgcatcggagtccatatagttcttcgtgctttcatacatcctccaattaattgttaaagctatcaggggagcacactagctctgggccacgctgtagatatcggcctaccttccacagctaatcagctaatgtactctcctaatagtttatgaatagggggaggggacgaatcctcccttatcctattaattaatattgcatgtaagatctaacaatcggttgcctttgtaggaataagcattatgctaatccagcactaaactcccgcccccttagtgggctgggttattaaagggtaacgcccttatgggctagttacatgaatgttagtttgataggagatctgaagtcctatctcaaaggactctcgtaagaatccttcacgatagtcacgctttgagcgtggtacagattaatgttgcatgtcgctggttgtatctctcaaaatatcgaggctttctccaatctctatctctcataaaggcttgtaggatgaagtgtctatcacactctagccactctgatacgtcgatagctagcctgattggagaccctctaaactctcttcgctccacactaacctctattagcaagattgatcacatggttgatcaccacatgttttacagatcactggtgagtaactacaggtagggtatactgacacaccatcccacgtctcacacccacagtcagggcatgtgccgttggattccatgtcatcatcgtcatctacttcaccgccaccaaaacaactcatacaggctccttagtaaactaaacctgtagcctttgcatcaggctgagggactacttttgcactagggcgatagccatccactgagccgttccaaagattgacacaggtgatatatccatcgtctatgatgtctgttttaatccagaagtgtttatcatgaccaaaaatacttccgtttggcagcgtggacaattcaacagttttaagtgactgcttagagtctagtttcatataagttccttaatataccaaaccatgtaaaagaaacatcctctttgtaagctctgctttagctctgtaataagccttagaacctaacaggcggctcttaacaaagaacttaatgtcattgctaacatcttgtattaaacgctcctgtacagtttctgaggagttattaatcgaatcaattaacacctttgtagatgtgtaattcatatcaccactccttaccggttgtaatcgtagagccaccacaccacaatgctgtatcaataacaacattatccggtgtagacttctcttcgttgatagaagggttagcattagaacaggttgctccgttccatcgcatatcaatttcaccagaaggaatcttctcacccttatgccagcgagaaacacaaacaccttccactgctactgcacaccatccatcaggacggctctgtacgcagcctgtaagggctatgcagacaaggaagatacagattaaggatattacaccaccccaactcataattacctcctattagatttggtggactatctggaatcgaaccagaagctcactaagaaagtaattcccactgttataaaagcacttgcctcaacagggatacactaactctggtgccgcacccatactagccctaaatgtggtgcgccctacaggactcgaacctgtaaccaatagcttagaaggctactgctctatccattgagctaagagcgcagaattatttagatcatatctcgcttggtgatatgaccacatgttttacatcgaagtatataacgagtacctgtgtcttctatttgaccaatctcattatatatgtgtaaacgaacttcttttattgtctcccaatcatgcagatggaatagacgtttaaaccacttgaacataattacaccacctcaacgagagatgttttccatgcaaacagaggtccattatcgttaagataaacagctcctcccgtctcgaacggagtcccataaggaagtgcccaagcatacccacgaatttctggcttatgggtaaacccatatacctcgccgttgctatcagttgctaaatatcttatagagctgtccactttaacaacttcgccaaaatatttaacctcttttcctttcatattaacctcaagcacaagcagggagtgtgatgattttatgcttaccatcaaattctccaaataaacctaagaatgtgggactgtaagttccagtacaaacaaactcatcaaacaatgcgttataactaggcttgatcttccaagcccatacataacccatcttgtcaattgcaatgtaacgagtgttcagaggaacagtcatcattataccatcaacttcgatcactttagtgattggtgcagcttggaagtttttcatactttacctttgataaaaatgtcattaccacagacacagcatgaacgaacaacagtagcgccacgctgaacaatacgaacctcttccttaaccagactaatacgagcaccgcagcaaggagagttgacataagagtaaccagcttgcgtatgtttgattatttgcttagacatttgattctagatctcttagttgttcagccaattgttcgcattcattaacgcagaactcttctgttcttggtatcccgttagggttgaaccgtgtcttatcacctgcatgggcacaatcaaatccgattgtatctaaaccacccatctcttcaagggtgtcttgccatgtgacaccaccatgaacacttacataacaaacctcttcctttccgttatatccggtgaagtttttatgttttaagctgtctggtagctctacatatccacaaaaatgggagtcgttcatgtgcataatcacagcacgaagacctgatttagtgacccaatctttaaccatgcgtctcatataagcacctcttgttagtttaagtaagagttgtcccttaattaaaacaacaaaggccacccgaaggcagccttttatttattaactgttatacgtccaattaccttgcttgttacggatggctgacattgcatgaatccaaaagccttccagtttcagagcaccattagctactgcatccatacgttcagggcggttcatacgtttggttgatactttcatacctatctctctttgttagtggaggcattattgccagttgatataagggatagccctagtcagtagactaaccctgaccgcgtactcattgccgaccttctctgcctaagagttcaggttctagagctatctcttattccaactggtgaagactccctacccctaggaagtctcctgaatcccaaaccaatacgtacccctacatatcggaaagtctttcgaaaattaacaggttttagtctaacaccggatgttcgagcaagctctccctagcggtgtggcatatgcctgaattaataagttaatgaggaacaccctcacatagccctctgataaacacaagggctataagtcggtgttacttttgggataagcacagatcaggtcgtggcataacagtggttgatagaccgaagacttcaacagaaccactgctcaagttagcagccttacacaaaccatcaggggttttatcttctagcatcagccagaaacgtttatcataagagaaaacatcaccacctttaacgtcctctgcatttgcatatttaggataatcaactactttaatttccatctaattgcccttattgatatatagaaaggtggataagtttattaacatgagcgaagttaggaaggatttgcatctcattgttgaagatattaaaacaacgaaccccgccctctacagcataagcagatttctgaaacagactgcctccccacacaaatacatcatgtgtttcaagagatcgtaactgaacagcctcgtcaacaaccttcttttcaatgttcatattcacttccgattggtaattactgcatcatggataactgaaacaggtaagtttgaatctagcttcattacttgattggtgcttaaactgagcactacacaaccattccgaagatcagtctctgacacatgtggtgtatataactgaacgatcatgtaataatcaatacatgttgccttaacttggaatacatcaccaagtttcaaatcacccacacacaattctttagctttcatctcaagatcaatcttcatctttagcctctatgttggttatgtgaagatcactacgtacttggcagacttcatcccgtttaaaaggcatgagctttccagttaccacatcaacacagttcacatagttatctgcgtatagtgtgtcggttctaatataaagagagtctttacgctcaaatagaacgcccggcttcatgttatttaagcgaagcattgtacgatcggatttaatattaactttcactgttaatctcctgctgcttagcaatagccactcgtaagtcttcattagcacgagcaaggcgcaacacttcatgattgaggttctgaagacgtttgtttctgtcttcaacttgcataataagatcgttgagtgttactttaactttctcgttatacatctcatccactcgaactagtgatttatacattctctcccagcttgctgctttgtttctgagaacaataaaccctataacgctgatagttaaacagcttacaaaaaggaatttatatacttctaaagtcatatcatttaccctttatcagagattaaaagtaatattatttaagtaagttatatttagtaaacttattttctaagaaattttcaaagggtctatatacagagcattacccatagtcccagaatactgccatctttttcaataaatttactaagtggttggtttataaaggaatttagtttgtcaaatctggcactagtgattattccctagagctattatcgaacactaaatcaccacaatacataggattggcataccattttggcaccccttcgctcttactctgaaagtaagtcccactgtacagcggaacataattcttcttaagggcacgtttagcaagtcgctcgctttctccaatggcttgcttagtcatcggatttttatcacgaatcagctttacataacgtttataaggtttctcctgttttaatagtaccggaatccactcaaactggttcttttgtcttatcacctgttcagcggtcagttttcgttgggccattctatttatcacggtatccgcaactaaagccttacatgcggttggctgattccctgcctcataataaatagtcaatgtcaacattagctgtgccgttgttatcagaacttgctacctcctgttttgttgtttcaataaacaccctcgaaaagatgcttatagaaacacccctccctttcgggagaggcactatcttaccactcgtaacttacaccagcgcccagaacagcgtcactctctgaagtcattgccactgatgctttagttactacgttttcattgaaacgagcactaacaccaatagcaagagcagattcaccatcgtaagcacctaccccagcaccaacagagaaagcagatccttgacttacttgcgggatgttagccattgcagccacgccagaaataccagcagaggcatgatcacggttacggtctacttgtttttgcaaagaagcaaaacgtttgttggtggattgttccagagctttgatagatttggcgttagcattaacggcagacatatctgcatctttaccatttttgccatttaatccgtcaacgccattcaaacctgctgcaccagttaggccagtttcgcctttcttaccatctgcaccagttaggccagtttcgcctttcttaccatctgcaccagaatcacctttttcaccttgagcgccatctttaccatcaatgccatctttaccatcaatgccatctttaccatcaatgccatctttaccatcaatgccatctttaccatcaatgccatctttaccatcaatgccatctttaccatcaatgccatctttaccatcaatgccattagcgccagtgtcgcctttctctccctgatcacctttttcacctttaaaccaatctccgataccgcaaccattggtagattgacctacaccacaacctccattgccattgccattgtttccacttttagcaataacaggcgatgccattacggacagagctaggattgaggataatacaattgctttcatttcatagattcctatacagtagacataaaaaagccccagccgtagccggggcaaacctgaaagcaacacatgaccgttgctataaatacactcgcaaatgcacttatagcaacgcaaaaagccgctcaaaggcggctatgcggaagcttcaaatggggagagggcacgacgccatagaaagagcgtcatagtactaaaagagggggctatatttctactacttaacccttgcctctttgatagggtcgatgtatttctcaacgccccacttgtgtttactgtctgcgtagaaaacatcaggtgcacactggcttgtcttagggaaagcctgcgggtctttcgtgctacctttaaacttctgtttaccacgggtgcgaccattacagaagatttctaacttcttctcctcttctgttttagctcccccgctctttaacaaagaacgtttatgatcagctaacaataacgcatcagcacgatgaacacgatggcctacacgctttgcaacactagaaggaacatgggattcagcctcagcctttgcagcacgacgttttaaactacgcttactaatgtgattagttgccttcggtttctctttctccagttcagagatagcaaaacaacgcccgcccttcatgctgattttagatttagccacaatcttattccttttagtgataagttatatcgggcaagcccatcaaggcgataggcttgaacaaataacttaatcaagtaaactaaacgatttccaactacgtagaaggattgtaccgtcatccataactacgcataactttaacagtttcttgttagcactactcaccgttgtaattcgtccagttgtacatttacctttattgctgtaaagatatacaacacgacggcctaacaagcgggaaggtgctttcttaaattctgaaatgttagtgatcataatgcttgatacctttgaatgtgttcaatacgggtggattgagcaaatgacgctttaacagccattttcctaacttcttctttacgctggttagtgtgtacagtatcccaatgtttgttatcacgttggcgctgtaatatcttactacatttgcgatggtttcccgtgctgcgatgtttctcacaaataggacacttgccaaaattactactgaatatcattttctcaatcccagctttcttaagatacggcctaacgttgtttcttgcgtgataatatagctgattgcttcacgttccaatgtttcaatcttcattggtgacggataccattcaccggtaataacacatttacattcaacgccatactttttagataggcggtaatgttgaccgttgacaagattcctataaatcgtggtatgcgtaattaacatgatcatcacctttgattaaattctttgattaatgcactgaatcaatgcactgataaaagaaaaggcgctacccgttaagatagcgccttatgtttattcaaattgtcttacttatgccgcctgacgtgccgccataatttcagccgctttacgcaatacttcttcctcttctgctttcgccgcttgttcggtacgggtagcaaccgttgaagagatacgaccgcgcagactttctaacttctcctgcatagctgcaacagtcttttccatttcatcagcgtatgaatcgagtgattctaattccttgcttgatgcgttcatcagataatcatctgagatcgctaccgtcgaggccgtgattttcttgatgagtgaatcaaaggactttttaaccttcccaacttcttcactcagggcgatagtgttatcgctggttgcgccgttgcgctcatcagccagtaatttggcttcaatacggattgcattcaagcgttcaaccaaagcgtaaatatcctgattaaaatcttccttgtttttcgccggaatttgcaggtgtgccgccacgttgtcattgcaacctttgtagaagttaggattatccacttcaattgcacgacctaatgcaaagttttcgaaagcgtttgaccagcgagcgcggttttgttccattttggccttaatttgcgcttctttcgcatcttctttagctttcgcctcaccttccagattaatccactttttacgaccatttgccgcatcggtgttaaacttgataggagttaagaaagtaattgcggtagcgataacatccatatcacggaaacgttcagttaacagaaaatcaaccgccgtctgcaatacttccagctttttaccgttactgcggaagtgctgcaagtgccctaacagaaaattagaaacatcttgtttgatcgccgcgttattgctacgaatgttgttagccagtgcattaaaaccggattcgttaaccagagtaaagattttagccatgatattcacctttcaattgtaagggcgctattgccccgctctctatgagcttgtttaagtcactattaacttaactataaccactcgttgttaagtagttataggtaagcggggcggtcttatcaggagttaaccttgccgcccccttatccgtgatgtttcatctggtatctttaattagtcgctataaacgaagccgacctgatagcgatgatcaatcatcacaataaggctatgcgtccgactctatttaattacattgctgtaaccgtcggcaatatcgtctactttgttttcgctcccgcttatccttttgtatcagctctctatcgctagtcatcgcccactacgggatactattgcgaaagagtcactaaccgcctaatattccggcgttttatatctttcagcaggtttactacataacccggctatgtactttcatcctatgatgaatctcaagccgttcacatcgtaaacgttcgcattaaaccttattgttaaatagcaatttgccactttttaaccactccccgccgctctcaattgagcgttaattcgtcggacttgcctaccctgattaacttctttcactgtagcaccgtgttagcaatgaccgccgctacccttaaccgtgggcgattagctcaagtctttgcgtgtactcaatgaatccgtttatcaatggtgacgtttccagtaagggaatgtaaaactgtttaccctgataatttagggagttttacgccgttttatctggtatgctttccgatggttattatcatcaagcatattcaaccgatataggagaatgtttaaattattaaagagcggtaaatctatcagtgtgctttctcacactatgcaactgttagccgttgttacgcttttcactgaagcgatgatttgcttagtgagtgctcattatgaatcatgttgttttcgctgtcaaccgctttttaatcttttttttcgtcgttcccgctattgggaggatatatcaatcagctttatttgattgaagattaagcggtgaggcttaacttatgactcatattgttaaagagcgtttagccttttaaagtgtctgctaatcactgtcacattgaaggcttactgattcattaacaggccgcctacacctgaactaatcgctgcactatgtgccacctttcccgcgatacgttgatttgggaactagttagcgatgttttgctaacttgtggttagtatggactactttaaccacgtttgcaactctttttatcatcttcttttaattcctttcccttatctcgcgtgaatctatgcgaaagggcaagatgataagtctgatttgtctttcagggaatctagtgcgctttcaagcattaatcttttgaaagtatcgaacaaataaggcttattgatattgcttattgtccgcctgcgtcacgtatgaatcaggaatcaattctaccgattaactgagcgccttatagtaatgacgtcgccgccacccgtaagacaaatcatatttttaaagagcgggattttttaagtcatcgctgactatgctcactatatatcaggctgttttcggtgtcaatactctttttaagaatattttcactttctagcctgatttttaaagagcggggcaagtttccttgccttgtatgttttacatcgtacccgatgaaatgaagtatacattaatcagtgagggatgcaatagggtaaaacaaaatattttaaactttttcactataggaaggtaaaagagcgggcgaacgtgatacatcataggaaaaggcttgtaaagcgataacaagcggcctataacgcatcacaatgagctaaaagggagtaaggtatacaatcaccttagaaaagaaaaaagcctcatagcgaggcttataggaaggatttaaagcatcagatagattatgaccataggcatgactacggcacaatacaggagaaagattaagcctatggatttacacattgaccattaccggactcaatttcattcatggactcatcaaagagcgtcaacgatgagcgcatcaagtgatctatcgtgatttgtttaccggtagtttcatttaccagcagaatagctttgttatctgattgcacatgatcaaaatcatttacatgcaaaataataactttaggtgactgtttaccagtttcatagttttctatcaaataggtgcactgtaaaccgtcaaccgtagcaggggagaacattgcagccttaacactacccatagacgataggagaacgcccagcaggagaacgacaaggaagaagcccacgaatacttttactacaaatttgataatacccatgataataatcacctatagttagagaatataagaataaagcatatcagcgacgaataacgccactgtaacgacgaacaagcaacgccaaaaataatcactattcatcgttgctattctcgccaaaaaatgctacgctaatctgttccacttcttccagcgacaggagaatcccgcgttgggctaaatacttcccaacagttagataatcttgcactaaacagacaataggaaagcgtatattttcaatctcacctttggaaagaaaagacaaatatccaacgtcgattgattcatcaaaggacaacgtaacgccaccgtaattatgcgtatcaattaacgcaatagtttcatttcccattggtatcattcccaatcagaccatgattaagcaggttagccagcgacaaatcaccgtcaatatagattgatctgaaatcatcgcgggtaatttcgaaatcagcaaaggctagccaatctttaagaggctgatattccatcctgcaaaaagtgataacaggcaagattatctgaccatcaagtgtattaaacaggatagagcttccaccaacaaaacaagaaaagccattagataacttaatttctttgatagccatttttacactcccaaaataggttatttacttactagccttaatgcagttggctaaattaacgtgaacggtataaacagcgttatcagcgttattataaacggtagtggcgatcatcgactcattaaccggaccataactcactagattggttacagctttaacgtctacgtaacgttgtacagtgccaaatgtaaccatatccgagtcactatcggtgcgcttgagaactagatcattgttaggctgattgtctagtgtcttagactgaaagagaacgccatcattagttacgttgctaaacttcatttttaatacaatagtacttccatcactatccgcaccgttgcaaatcatccaacccttattgatggaactagcgaaaacatcagcggcatcagttgcaggagtaggactagcgatagccttatcagaaagagatgtgaccagtgcactaacaccaatagctgcaaccagtgcataacttgccagattaacagacttcataatcttacttgcaacagtaggcttgattggctgtttcttgtttttcttgttccatgcttcaaccatgacagacaagcgggataattcagctttcacatcacggcacgactcaggccaatctttctgattccagctatctaaattagcctgaatgtagcaattaatagcgtcctgcatatcggtaaaaccgttctctttgaacgtgctttcatcttcacactgtaaagcgttcgcagtagaattgatgatcaagcaagccaacatgattgagtttttgaatcctttacgtgcactttcgttttccatccacgcatcaggactaccaacggttaagcctaaagaggaaaggctttcgtttgctttgttcaagtggttaattgctactttagacatttgatattccttatggttgatgaaaactacaaactacaatcgcaactatataataaaggaaaaggctgtcaaccatttattttctaactttcctataactcactgaaaactaaaggaatttaatttactaaactttccatactcagagaatcagcttactagatattgttactttataacactacgggtaacagaccaacagaccaggacaaacggggatacaacaaccgcaggacagaccacggggaaacatgcaagatagtgcggtaataatataccacttaaataattgtataactcaaacatcaaagaccattcgctacgctcatgtacgctgaaaagaaagtaataaaagaaacaataaacatcaaacataatctttccacttaattaatacatatatcattattgcactcataataacaactattgaaactattatcaacgtaactatgggggaatggggtagtaactagggggtattattagcttattcatagtgccttaatctaatcactatacagtgctggcctttctctcactctttaaaggggtactaaataaacgggtaggtaatgtattgggtagtatacacgggggaataactacggggagtaggcacggggaaaggtggaacgttgaaagggaaggtaaaggcattgccaataacccttttttaaatgaggactccccctttttaggaaacgcgcggcgagcggct

SEQ ID NO: 2 - DNA, 44933 bp, artificial sequence
  BP700
tagcccacccacgcccaccctgtcaaacgctcaggaatggccctaaaacggcccgtgtaagccctaagcggttgcactaaggcaatcaccttgtccaatactaaggcgtgccctagcgcttcctaggcgttccctccgcctcccttgtactagacaaggagtacatcagccctgcccgtcgaagacggattccctcaggccaccctatgggggcaacccggcgagggcgagggcgagacacctcacacacgaccatatcaaaattttgactttggttaatccttgtacaggactaaggatctactattaagcctataacgaaacctatcaacaagcataggcaacctactattgcttccataggtatatacataagacctccattgtaaatacactaagagcaaacctaggtctgcccttgtgtacactaagacattaacctgcttacgcagaagatgcagaaggtttcttcattgcacgacgttgtacatccttggcaacggcataagcttgcttagggtcacgtcctgattgaataagctcttctgtgttctggcgtacagcactttgcttaactgatttgattaatggcattcaacttcctactactttgcaacccaaccttgagcagatgtaccagattctttaacgtacaatgtactaccaccagaaccattgatatcagttactaaagagcctacaggtgcacctacgcctaaagttgtagggttgccatttagtccataaacaatcaccgtactagaaccaactccttggttattctgaggtgcctgtgtgccatagcaatcattgccaatgagtttaatattggaacaagaagaagtaacacgaataccaaggcttggcttgttagggctttctccgtctactccaatattaccttctactaggatgttgttagcccctgtgtctatactaatgaagtgcctacctgcttcagctgtagatacttccttcatattattggctttaatcactagaccgctagccttgcagtttacatgaataccatattgccctaatttagagaagatattacgactaagtataccttctcctgataaaccagtaccaatgaatgtagtagcatcagactcacctaaccaaatcccactacctcttccgttttcccaagtattaccttcgatgtggtattttgtcccaaagcgtaaaccgattaaccctaagccaccagagcctgtattaccttttacaattaaattcttacaccaccttgcatctacaccataggatatatcctctgtgaggatcatagtattattagaaatttcaatatggtcatgccaaatgtcactaatatcggtaaaaggccaagatggtgcagcaattagcactggtgtccttacgccatcaaaagtgcaatctacaatattaccttgtcgagtaccctgcggtttagtctgagatgagacaggtgtaacatggacacctcttgcattagagttcctaaatgtgcaaccacgcactgtccagtttttccagttaaatacacgtacacctgcaaagagagcaccatctgtagtgcaattcaagatacggatattgttgtcctgtacaccgtaagctgaggcgtgatttccaattagtgcaccataacctccaaaccctgattctgtgtttggaccagcatagcaattctccaccagcataccacttgactgtacatagtgaccaactgtaataagacctgggtctaactgtatagcctctgagaagttacgactgcctgtattcttaaaacctaggaatttacaatcacgaataactacgttgttccaatctgctaaatctatggcgtggtagtccactacattgttaactgttatgccttcaaacttcaaatcattattactagtagatgcaaatactacaaaaggtgtatctcccttagtgtgaccattgccttcatagatacctccactgactgttacattactagcttgcccttgtgataatctgaatagcgtatctcctgtttcgtagtcacgtacaaatgttacacctttagccaccttgaagtgtgtattagcaaatatctcaacagtaccactgagtttgtattttccagctttagtgactaatacagtgccaccgcctaacactctgactgcattgaacgcagcttgaagtgcttgcctgttgtcattggaagatggagtaactccaaaatccgcaacatctattgtatccgatagtttatcagatagcaggcgctcaatagtacctgttagtttactcttgtacttcaccaagtaagcacttaatctttgaagcatgtaacctcctcttctgaaaggctaccaccatgataacctttaagaaaagttgcgtgaaaagcagtgcttacgcactgcctgtctctcacttaggcagggaagctagtgcttcctgcatacgcttgatagtcctccgcatcaacgcagcctctaatatcagtacttcctcgtaacgaataccgtagcgggaacctgctggtgtaatcagtttacgagagccattggcatcttcctcgtatacatcatcccaactgtcgaagcacaagaagccatagcgatgtgcatctatgccgtgacgttcgaaagcctccttagctcgctgagcgatgataccgaagtgccatctagctgagtctgcacccttctcctcaacacgatccaaatactgaaactgcacaaagtcaacttcagaccaagcatccagtaaggcatctgatatagtaagaggttctgttttacaccgagcatctgaggtaacagtgaatgctgcttgagtaaaaccgccagaccatgcccgactggcggaacctaatgcatatgtaccagtactatctggggtcattgcatcagcacctaactgcaaaaagcctttgctactggtagaaagacgcacgttaccgttggtgagggacactgtccgagaagtaccatcagaagtaaataggcgaacttgagaagaagtgcccccacctacagctaatgacacagcaccatctccaagcattctgtacttatcagcagaagtaagaacacctgaagggagtgacatggacttaatccgccattcgaacctacctgacatactacctatgtactgccctaaggcaggtgcgtgcactacgttactattattagtgccgtcaatagtagctgcaccgtcaatagtactagcagaactgagaatgtcgtttctcctgccagggtgctttacctctacgaagttacgggtagagccggattcgaaagtaataacacctgtagcactgtagctaggaaatacagacgcatagttgttattagctgtacctataaagcgtgcaattgtagcagtctgcctttgtcctaaagagttagtaccatcacatcctgacataagcacattatttatgacgttatcagatccctctacggtaacaccatgagcctgcctagcatcagaagttgagtaatctacgagcacgtctgagattaagttcgtacttcctttgcctgcaacaaccgctgcatacttagggttattagccatcaccccattgataaggttattagaaggagctattggtccttcagtgccgttgtaagttacatgctggcaatctgcccctataacattactgactatgttgtaactggctgtacctttcaactctactgctccgaactgagggtagttcttagcaatgacgttatctatgagggagttaactgaggagtcagcaagtacgcatccggctgccttattagtagcatagcctgaatagctacctcgaatgcctttaatcataagtccatcaggtggcgcatcattagggtatgcgattaaactgaaaccagtacctttaacgtttgagaagttaacgtcacttacagtaacatcacttccaccagcaagagatacctgctgtccctgagttgtatcagtcgccttattactttctaccgtaatattacttaagcgacctgcacgtagattgttaaatactaagtagttacctgtactggaacggtgacttagcacgccactacccctaccgtctaagttacagtaattactattaataccagagctagagaatacaccatctgagactgtgacagctttctgagagtttaatgaagcagctataacctccgtatcatcagtagtggcgtcacctgcagcaccaaacggctttgatgttaaaactctcgcatcaaggtactcatacaaagattgtcctttatgcaagattccttcagtattaggtttggttaatttagccatgctatctcctattactttccaaccctccctatgaagattggctagtaataggccgctcaaaagaacggcgctatcttatctcttctatagtgtccagtaaatcgtaagacactgatacataaagctatgtattaattatatccgcgttctagcgaaagaatatacaaacctaattttgtagcgtcaggcttactaaagcagaccttatcgtctacctcgtaaacttccgtcagcgtcggcctcagaggtttcaccattgctttctctggtaacgcctgctgacacccggaagtggtcagcgaaccaatcagaagggttgtcactaacatgattcgcttcactttgtgcctccttctcttcttgtttcttcttagcagagacaagcaggccaataagacctgccagaacttctagaaacttattcacaggtgatcacttggcagaccacatctgtcacagaggattccgtgccagagccaaggtctacaccaagacctacagaaacaagagcaattgccaatgcaactagtgcacctacaaccttcttagatttgaacagctttttcattgcacctccctttccattgtgctaataaagttgagtagttctgccaatcttcataattaccttcctctgaagccttagcaaccatgagttcacaccattcaatgcatcttaccatcttgctttgttatctctaacgtcgatatgggtaaaagtaggataagcaccaataccgtacttatcatggtatttattgcagaggtatgcacgtacctccattgggccaacaccagacaccttaatgtcagcagccttaccagtaagatgcatggagttcttagctccacctacgtttgcattatgctttgcgcaacgatgaccagaggtaataactacagggacgccaaagttctcacgcacatctgtgactacctgtagtagctcagcatcaacagtggatgtaccgcacccacaacggcaagcaaactctttacgcttgaagtatttgttaagcattatacaacctccactggcattgaccacctaattacaagagacagcttaatatctgttgccgtctctttacgaagtgtaacagcaatcaagttagtggtagccttatcgacatctatattggcaataacaggactgtcgtctccaaaagaagtacacagcacattgtcaactgtatagtaagacccactagatgttcctggcaaattaggaattgatatgtttaatttaaccgtatcgcttgggttttcgttttcattaatggtaaggttaatgttggcagtcaattcttgccggtaaactgtatcacctgctaagtccttcataggcgtctgtatgcacacagtcctcgctttggttacattaacctctactgtgtcgcttgcacttgcaacttcaacatcgatggtatcaattagcgctaatgcactcgaatcaggtagggttgcttgctctaaaggcaaccacttatcttctggcttagaacctgttgcagcatacaatgaataacgtgaacctttcttagccagaacagtatatccttcctgtttacctgataggtacttttggtttagataagagttaacgtcagacacatctgagatatcaacgataggagccacttccgtggcaaccttagcttgatgacttacacttcgttgtcctgtaatacctaacacgataatatcactcccctggtgtaacagcagtgacatccatagcagttacatcccaagcgtcggttggctcactaccacgtgcaatagcaatatgcacggttgtgtccgatctcgaaataacaaccattgcacctctctgtttacctgataaatatttgatgttgataggatgatctttcttcttaaggtcttcttcagcaacaacaggcataggaattgccgttgcaatagtttgtactgcttttactcgaaaagcctgaccagtaacagaacctgtagtaccatatttagccatgtaatcttcctccttatcttaaactgggttaacagctggttccactgttactaacttccactctgaatcttctttgccatcaaccgcgatagcaaccttcaatacaccaccttccacttcaaggcacaccatggcccctttctgtttacctgatttggtggcatcattaatagcattgcttttcttactagcttcctcttttttgattaccggaagcattagttcttcacttacaggttgtacctgctttctcttagacttacctgttaatggttgactactataatcattagccattgtctctctcctattatgtaaatatagtaaggtagtaaggtagtaatgaatagggtgtacaggagtacacccatactaaggcatacctatataacctaggttaacctatatattacctattattttctcttattatctgggccttccttctatagtgtccagtaattaataagtccttgaaatccttgcagaaagtgtatttctgcttgccgatttatttcggtagttctgcccgtaaactcgctgctgcatcgctacggaagtgttggtcactcttcgctcagtaccgtaatccccatatagcattgccctgcgtagatgaggtgtgttcatagcatggatgtaatctcgcatctcctgcgctctgaggcgattaatccgtgtaacctcgtcatagtctatctgagaagttaattgccgtatagcgccatacagggcgtctaggcggtcatcgtgccggaggctgttcttctcaatcgttatgttcgacatttgattgaaaagactgtaggacatgcgtagttcaagcggatagtgctgtaccgactcaaagtctgacttcaccatctctgcattgaagataagcctatgtgctgccatgagcggctccagcgtctcaatgatacgcaattctttctgtccggtggcgtaatcttcttccagagttacaggccactctcgttcaaagtacggcttaattaccgcctcaaacgcgccatgaccaaagttcttctcaatgaatacctctttaacacccgcctgctttgcggcctgcacaatgcgattcagggacgactctcggtatccgccaggtacaccaaagcactgatacacataaatgaatgtgccgtgcaggaatacgatggctacacccgtctcatctccgttcttaccaccacccgcagggtcaatatacataatcttgcgggagacagcaccccattcgtatgggcgagctacaggtctgtacatgaaatccgtaggcttgttaccatacttaggtgcatcaccaatgatgtttatggaatcattactccacgtaggcatcacagggacttcctctgtaccaaacgaggtgaagattagattgttcaggcgtaatgggtatctgtcagcatccatcatgcgagtgttaagcatgaactgaagctggaacttagccgcaccctgagagatttccttctcaatcaggacttcatcatcatacatttcaggggcacaaggtgcaccactattaccatccaacccgtaccctgagcgaagtgctgggttgtccttcatatcttgaacaatcataggtgcaaggaagtcgccataacattgctcttgctctactgaagggtaacgcgcagtccagatacgaacagagtaaccacgagcaggtaggttgttgtagatagagtttacgttctgaggtgtaccaaggtaaatgatatccccaaactggttgatagattcaaactccttagtcagttcctcaagcaaggcacggcccgctgccgtacgagcgttctgcatcgactctacgtcatccgctagaataatatcagcacgagcaccctgcatacctgcttcgattgagtaacaggatacagaaggagacttatcactaccacgtagggtgtaatgaatctcaaacgccttaacggatgcacggtccccagcgtagatatccggcagcataaactcaagaaagtctaagccacggaagattttaactacccaacctgcgatttcctctgctcgcttggcgttttgggacacaaccatgatacgcttatgcggttcatgaataatacggaataccgtatagattgctgatagtgttgtcttagcgataccacgaggcgcttcgatgaggcggtacttgtgtccgtaaaataggaacttcaagatatcagcctgcatacgaatcagatgagggttgcctgcaattaagttatgaataactgtatctgcaaagagaagcaaaccttccgctgtgtaaggaaaggtctgctgtaactcctgtagcatctcccatctggcaagagcctccgcttgtgattctcttgccttagccatcaatcctccttagtgaattgaattatcttaccactggatgcctctcggatagccttgaggcgcttagataacttggactcttcctgctgtgcagcaggtgtggcggtaatgccgttatcaagaacccacttacacatcgcaccaatatccttaccagacactaaatgtaatgctgcatcagggtcttcttctatagtgtccagtattgcctgtgcttttttattgaagattttggtaatagcaccatgcagaatgccaacctcatcctctgtagctgcatgtttattgtgtacgctcacgcttctccctccaaatcttgaacttattataaaaccagtccccaatttgcaacacggtataaatgaatgttgctattaacacccaattatcccaactgataccgaggaagtacccacctgatacgagtgcaggtggcgcaagcttcacaccactatctaccagttcggagttaatcatcctacctccttatgctgtgataatcttagcagtcatccggcattctggcactccctctgagaaagtaacaatgtcaccgtctacctgataagcaagtttaggttgtaataatccatcaaggtagacctcaatgtacttaaatgcagagccaatctgtactacttgttggccttctactaagtcaaagttcaactctaactgaatattaggttcagatgtagccacacgactaccaatcagcacatacacctctgtacccgccacaagcggctctgcgaaagtgatagtgttgttgcttatagagtatgcgcctacaatttggtgctgcaataccccattaaggaaaactagtgcatcttgaaattcataaggtggttttacggaaatctcaccacctttggctatcgtgtaccaaggaacagttctgtgcgcaataccagaagtcataccagccttaaggccagcaatctcaatatcctgtttggcgttccaatctgtatgcttcttgtcgatggcatcaagctgccctttatttactgcatctcccggatttgtgccatcagccaaatcagtaatcttattgccgccccagcttacattctgtttaatgaagtatccttctggataaaacccgtcaagtaactcctgtgtaatctccagtatatgaatgaaagaaccatttaaagacttcatatccaaggtaacaccacggtcaaactcagcgtatggatactccttttgtacttcccttctaatacggaacttcaaacctgcaactggtgctacatcaaaagtaatctggtgcgtgccagttagttgccagccagatgtaacctcaatccaagtgttaccttgaagagactccactatcacatctgaggcacgaagataacctttatccctaccagcaaagctaaagggataggttacttgcgtaccgttggctatatgttctgtgaaagtataactcattaatcctccagttcatctaagccataacgcaatgcgttctggattcctattacattagctagaggcactaagcgtaaagtcctacgtgccacatctacaccttctgtatcaccctctgcgtatttagttatagaatctgctaaacgatatgcatcttgaccaacacctactagtggtatttggtctatcaaacccttagtctgaaagccagcctcataacgggattgtactaactcagaaggtagaacacctaggccacctaagaaatctccacctagactaaatacagcagttgtactcatcatacccattgcaccaaaggccaaccctttaggcgataacttctcttccaaatattcatcttggtcttctcgaccaatagagttcacataggcttttgccgcatacactattgaacccaaagcaaaaccataagctgtcttcttagcaagaccaattttatcgtggcgaatccctcgaccaaattgcttctcaccagatacaagagagaatgacttaagctgtgcaaatgtcttacctagtgctttgttcatccagataccttcatcaccaatgaagttacgttggataattagacctgacttacgacgaatagcattagctaaagtttcacccatggcataaggcattgtatcaaagccaagcaagccagagcctttagagttagcatcatagtgcttctgtaggttagtcatgaactcctgagtaagaccaagttcctccagtttcttctgaggaataatcttcttgccttcaagatggtcaatgaaagacaaagctatttgcctattggtcattcgctccagagaaccctgtgccatgcggaagagggataggtttgtctgagcacgtcgtatagagttcatggactggtcaaaatgggccatcatacctcgcactgtggttacatcaccaaactcatctggacgcgcacccttagttgttagccagttgtcttcaccaatgtaacctaccattcgctcaacctcagctaaattcttatctcgaaagaagccatcgccattacgcaacgccttagaggtgaagcggaattgcttacctaaagccatagtggtggcagcaataccaaactcacccatgaagttagcaagttcacctagctgtgcgaagcccatctgacctaagcgaagtacacctgtaatgtcacgcccacgacgcagcattttagtagacaaatcttgtgggtttgaatcgatagatttacccataatcaagcgaagcccttctcgcatctgacggatttcttcatcaatagccagaccagctgcttcatctttctctttcaatttaagtcgcttctttaactcttcaatcttctcttgtgccttcttgtaatcaggctctgattgacggatcttagccgactccgcttcaaattgtgcgtgtgcttttgtatctttagctgcatttcgtgcatttcgctctacaagatcaattgcattaagtgcagcctgataggtagagaaaccttgacgagccaaggcagcaccacctgccgcttccttcatgtagttatctgttaactcttccacgttagtgttcataaagtcacgcatacgaatgccattgtactcttgagtaacatctaagcctaaactcatcttagctcggttagagatattatctctggtttctttattatccagagcttctaccatcttttcaatctcttcatcactaaagcctgctttgcgcattagtgcttcatattctgctttggtttgaccagacatagccttttcaaagctaagctgtccggtcaaggtggcatcagcaacgcggtttacttgtgctcgtgcaatatcatcagccacttcctttggaaccttacgagaaccattctggtatgcacgagagaataactcaatgatgtcctctttatcgtgcatactgaattgacgacgagccttcatactgtcaaaaatatcaggcatgtacttatcatctgctttaaccttttcaaacccagattcaccagagcgttgacgtaatgctaatgcttcacgatacatagcttgctgcccctctgctgccatacggatagacttaggcgtagactcatccataccgatgcgtacagcttcccataccttctcattatattgctgcacatagtgagagttagtatgacctgcaaccggattgatattattctctttgagccataaatcgaacccatcgttgaaacgattcatatcagcagatttcagacggttcaagttagtattctgcatgagactagcagatgccttctgcatacctaagccttggggggactcaaacaggcgagcaccaaggccgcgtacacttgcatcctgagaggaatgtacgacagtaccaagggcagacagagttccggcccagcggcgaggggtcatatcaattgcattaccttcccgctgtagggttttcagcaaatcttcacctttgctagagatatcaaatgcaccctcagtgagtacctcttcacccttaacacgcatcgcaccgatactatcatcagcaacagcacgcacatagcggtcccctgcgtctgcactgcgcacaatgctcgcagccctgtcatccccttgctcactgagcttagtggccctaccacgcgctacagcgccaataacgccacccatagccataccggagcctagtgctaccataatgtcatctaaatcacgagtcatgtcaccttggaccaatacggattcgatagcggcattacttacgccagcggcgatagcgccacgcacagcacggcctacgagtccaactttagcggcaccaccggttggaatagaggcaacccatcccacagggtcaagcacagcagcgccaatcgtcgccacagagccaacccagccagcctgagcaatgcgcttattgcgctcaagatcttcatcagcattctgaatacggaagttcaattcatcctcagaacgaacaccctcagtgattgtctgcatcatatctgtaccatatttgaaacgtagtgcttcacgttgctcaggttgtatctcgaagtctggttgaggtgtgaaatcagcagtggcacggtcataccaccgcttgcctccgaatgccaaccactcattctggaaggcagcacctacagcacctaagatatcagcatcagctttagcttcaagaacttgctcttgtaactcattacgctggcgtatcgtaggagccgataccggagccgcctcaatagaaaacggctcaggagtagactggacatatccagcccaattagtcttaatgtcttgttccataattcctccatagtgcctatcataaagacctgtctcacatgtgagacaagccttgagttagatactacaacttaaatttacctaccttagaacctttagctaacttggtaggtgcagcctcataaacctgataccaaccatccgcgccaatacgtttatgagtccatgccgagacagaacctgctggcataggtccaccaaacctaacccacatggagccatcttcacgagtctccacttcggtaatcttaggcacaccaccagcagatgccatattgtatgcctcagcgcgtcgcttcagtaggccaggaatacgcttaccttcacttgatgcagtgcccagcatttcgataaagccttccgtaagcttaccagctttaaatgcagcaagagcacgcggtgagttctggattccacctttacctaaattgtaggttaaatccatcaagccacgttgctgtgcaggatgcatctggtcaaacgggatcttccagtcacgagtagaaggcacatgcttcttagcatcttgctccataagagcgcgagccttgctctctgtaagctgagacatagaccctcgatagggaactagttcatcaccaatcttaatatacccgtttcgcttctcttcttccgttaagaaatgaccgtaaccgatagactcaccgtgagcgtctttatatggagtaaaggttccagttgccttattaaagccaactttatctttattctcatccatagctagcttgtcatagaattgttgcatattacctcgatagttaatctcgaagttagaaggcagattctcaccagaagcaaaagcagaagacatgaggaagttagctagtccaaatttaccaatatctttggcagttggtttagctggcataggctcttgtgcaccaatatctgtacgatacgggtgaacatactcgcctttatctcgttcctctactttcttctgataggcagaatctagtagtgaagtggtatctaaagaggttacagggattactccagaaagagggcgacctgctgcaccagcacgaatcacgaaagtacctttctgttcattgtaatcaatgtatatatcatctttagtttcccactcttgaagttccttcttcaattctggcatctgtgtttctacatacctaccaagcgccagaggtacatcggtagggtttacgcctttcccaactgacataagcatatcagatgcagaagtgtaatcacctttaatgaaatagccaccggaagtctttgcatcctctgattgagtgtagcgtttattgccccaagtaattaaagccttcttgatggaatccatgttacgcataccactagaccacagcatattagccttagctcgtaactcctcttctgcaatagctttacctaagtctgacacttcggttttaccatcgaaccagccagcaccagatacctcatccagtgcatctccaatagctgagttgaacttcttggtttccttctcagtacgagagaatttctgctgtgcttcacgcgcaaaccttgcagcctgcaaaggtgtctctcccatttgtagtgcagtgttgtagttatccatgtagccattcaccgtgtcaccaaagacacctcggctctcttctggcaactgttcccacaactggcgaatagtcatcaactcttgtggttcgcccttggcaaagtgctcaggagatagcatagattccatggctttgatacgagactcaaaggtatcatccactaagcctttggagttcatgaattgtagacgctgcacttccactgcaccacgaatagcttcagcctcttgactgtaagggtccaagccacgttgtttgatttgctggtctgcataaagttggctatcttgtttgataacatcaatgtaagccttcttctctttatcagtcttaccttggaagccagtcaggcggtcggagtaaagctcacggcgcatatcctgcattgcacctagctctgcattctgcttagctcgttggcgcatcagtgcctctagttctgggttagagaagacagagttacctgtcagattattaatgtgctgtgctcgttccaacaattcttcatcagttaaatcacctgcaaggtatgattctttaacttcgaaagacatacgagttatatcagctacattattcctagcccaaactgcattaccactagtgatggctgtgataagctgtggattcttagcataaacagaaacacccttatcgtccttcacatacttcagggcttcagccatgctaacatcaccgccttgtgcaagtgaaattgctcgctggactaacttcttgtgcatctgttcaggtagtaatccttgagtaagaccttcgcggattcgttcctgtaaagcatagccagaggcttcagggtcaatattagaatcccaagtagaagccactcgcccgtcaaaggtatcctcacggtctgcttgttcacggtcaagtttatgctgggttcgtgtagcccaaatctgaggctgctgttcttggaagacattagtgaccatacgcatagtatctttgtcaccttgcaactcagggtattgctggaacagcttattctgcatctcattacgagagtcaaccataagttgtgtccactcgtcatccgttccttggaaacgagtagccatgtctttcattcgtgctgcttcatcattagctagcagttgagctttgacaagcatgttagcacgagcgccaccacgagttgcatcctcagagggcattaatccattatatgcccgttccatttgaacaaccttatcctcctcaatcttctgattaaggatacccgtggtaacatcagctacactactggctgctcgaataaggtcttcgataaatcgactaccggaggtagaagctacgctagcctccacacctccaacttgctgaggtgcaaaggtcatgacattaggagaagtggcctgcacttgtggcagaccttgtactgcttgtcgctcaattgccattaaatacctcttgttccagatgaatatgtacgagaatcagttaaagctttacctaaagccatgccggacttactacctgttacataggcagatgccagactcggtataccttgcaccaaggtgctcacggcagaaggtttcttaaactcacgcatctgcatctgaccaccccgttggatggacttaagctggttggtgaagttaatcttctgattctcataattatcgataattgtactctggttccttccgccttctgctgctaagtcattcagcatagaagacacagagttaccaccagtaccagtagcaccagcaagtaatgcaacctgtgctctttgctgtagcagtgaagcctgattactgattgcatctgcatgatactgtttagcagcagagcgttctgcatctgatactgtcttatatgcttcttgtgtagaaattaactgctgccgccattgctcctcctgagctttcttcatagctttggcttcatcacttccaccaaaaagattgcctagaagaccaagaccttgcatacctgcactaagcagtcctgcattagagaagccagcagaagaacctcctaagaaactaccaagggagccaagcaaacctccgccacctgcggcggctgtccctcctgctgctgcggcagtaccaccagcagcggctgctgcaccgctacctgcaaacatactaccaatagaagacataccagccataacggctgaacctatagccattagaccctccttttggttggattgtagctcccttcccactcaatatcacgaagctggaatgtgtgaggtgattctacaataatacgataaacagcatccgtactcttagctctcagtgggaatctgaagacaccttctcttggttcaacataacctactgtattgttgagagcaccacctatatggtttgacgctagcaccctgcgtactttaccactcttcacattcttaacctccacggagaaatcaggatacatatcaagattaaggtgaactaatcccacaacaggtacatcaatataggatacacggtcttgcctatctctgataactacaggtgttggttcaaactcttgagggtaaatctgaccaacaataaccttcgcttttacgtggctatcatcatgcatatcaaaggttgtagacaaggtgttatcaccggggttgtatttgaataggaaagaaccaccaatatatgaatcccaaccctcgattaagatgcaatctaaaagttctgggttagtaggaacccaagggagcggttcagatacccattcatcttctgctttgaaatgctggaagattaactctgcctgtctatccattcggatgcgatcatttaaaccataggttaatgcatcacccatatccatcttctccagatagacaccattgcctctctcaaggagcaggtaaagtaattcgccagaataaaacatacctcgcacctttgtacctataggccacttccacacatgccatgctgattgtacacggtctgttccttgccataaccaatcgtagcagtagattatgttacgatacttatcggtagtgacaagtaacctgttgacattggtgcttgctgccatgttggtaatgttaccttcgatgagtttattcacatgacttgtgattgcttgtgccttcttagtgtcactataagagtctgtatagaactctcgtacaccagagtaagaaccatcattagtggcaaacattaccgattcaccagttactactggcttcactttattgttcacttcaaatgttgtaacaggcttaagcaatgcatttgacttctctaaaggcttatctcctggcagtatgaattgtgacttatcagagaacaacacggtagcgccatctaaggtcactgcatgttttagctggtagacttcactagcatctgagaaaatatcaaatgggtcagtcgccaatgcagagataaccgtataacgaaagaaatcgaagaagtatgatgtacgagaagcaataacagcttcacctgctgtaaagcataggcggttctgcaccatgaacatcccacctattgtctgaggtacttcttcatcaataaaagaaggcatagggttagtcaggtcatctcctactttacgatcttcccaatcgccttgtcttatcttgaattgagctatgccgtctacgatacctgtacgttcaatgatataaggcattgtgcctttatcaaacccaagtaatacatcggcagctattgtttctttccaagatacaaggtttccctctttaggctcagcttgcagccagtaacgagactcaggtttgctgccagtaggccacacttgcactttataacccgcaggcgcacgagaagggagtaggtcagtagagctaactttattcttgatagccactaaatccttaccttttgcaccatcggtggttgttattgtaaagctagcaccatcccgtctctctataaatatactagtaccgtctctttgtatttcatagtcactcacaccgctccattgctgtaacttagagtacaattcagaagtgatacgttcagttcgaatttgttcaacatggtctgcacttccaccatccggtgttttaaaactagcagcgttggccccattaattacaatggaataagatgtaccgtattgaccatatgcacaaaacacaatggctttgtttccaactttgggtgactttctgttactagctttaactaccttcctgcggttaagcatgaaagtaacatcagctatcgtcataaattgcacatcttctcttgggtttatcacctcagccaagtaagccataggtgcatcttgtgaagtcacattacatttgcgcccatacttatcaaatatctcaggaacttgtcctttcttcaacgtgaagaaatactcttcatcaccatcacctctgcgataatgatgagtagccatgtcatcagcccccgcatcaagtatctttgcaatatgagttgtacccatgcgtgattgagtaccattcactacatcaggtatcatattaatcatagctgtgcactgaccatccaagcgtaccgctggcggctgctggctaatcccttggatttgtctacctaatgaaccttgtacttccattaacgatcctcccacggacggagcgcccaactttcataaggtgaatgagagtaagcaggtacattctgagagccaccagccatgataccaaactgacgctgagtggggttatgtaccagcatgtttaatcgcttctgtgacatttgctcagattgtacatccataagaagctgagtggctatctgctgcgcagtggctagcttagtctgatctgcatccttagacacaataaactctacagcagcttgataggcaatagcctgcattacactagtaggtagatgctcatatggaagtaaggtaagtaaggtgagacgaatcataccattagcattcacatgcttacgcatatcaaaggtatgactccatgtagagtagagcttacctgctcgcatagtcataggtactttcttttcacctaaagcataacactgcaatactgctaggcagttgttaggtaaattaacttcaccgttagtgtctggtgcaagttgccagtttggttcacgattgaaccaccagccacctcctttgttgtactggaaccgctgggatacgatgtcgatcatcttacttgcatcttctgcatcaagatcgcctgagtcgagagaatccacaccctcacgaccaatagctcgcatacacaagttgaccgcttcaagcttgctatcaataatctggaaggccacatcttccatcatgtgtcctactttactggtttgtttaattacaggcatgaatcctcctaacaaaaagaaccctacctacgcaaggtagatagggcataggtattactcagcaggtttcattgcagtcggcttaatgtcatttgccatgacagcacggacagcagcaactaagtcttcagcagacagactagcagcagcggcagcggcagcacctgccggagcagcattcttgacgtatacagctttgcgctgtgcacggttaagaacttgagtgtgctgtgctccatcagtaacctcagcatcaccagtagatgagttacgcttagttgtcacaacagacactgcttcccaacgatcagggattgcaccttcagacatgaaagtatcaatgtagtaggtcttctctttcttctcatagaagatatcgccagtaacatcaatagaacgaccaaccagcaacgcatcagcagtgaacagtacagcgatagcgccattcattcctgcagtcgggtcataacgataaccgttgtcttcatttgacagcaggtgatgtttctgaccagcagagaatttagggaagcggttagacgggataacagggcagttgtaagaagacagaacaaaaccctgaatggttgcaccagactggctaatggtgtagctcttgtcaacgatacggtctgcatcacgcagtacgttgaagtagcgccacggcatcaggatagctacatcagagatgtctacttcctgctcaagctgctgctccagagcaaactctacagccgccattacatactgcgggttgaccagtgcttcactttctgcaacttctacgttgacagagaagccatggcctttaacacgcggattattacgcttagcctgagtgttagcaataccgcccagcagcatctgctgaatcagcatttcatcttccatcttcttaagctgcttagcttggttggtagccagcttcggtttcaggctgtcaatatcaccctgtacatcatgcaggtgtgcaacggtgttacgagcgataacagtggcatcaattaccagctggtttttatcggcctgagtagaggttgcagcaggagactgacccggtgccagaacctgcaactctgtttcacccaagtatttgttgcttaccgtgttagtaccagtaacagtctgaacatcgaagtaggacatgatgttctcacctttcaggtactgctcattcaccttaccattgaatttctcaatgagcaggctgtctacctcaccggaagcggagactgcaacgttggtcagagtattcggtgtagacattaataaacctccttataaatcaaagtgatattttagggagacatttctcccttctatagtgtccagtaaatactgattagagtccgcgagccatccccgcacgacggcgagcatccagtttagcctgatactcagcagccgctttcttgtctgtaccgaaacgagagctaagggtcatcatctcacgcaggtactgctcacgcgatagtgggccgttgtcttcagacgcagcagcaggtgcagagggttcaatcaagtttggcttgtcatcaccctgtgcagctttccggcggctttctagttcacgcacagcatattgctgaaggtattggttgccagactccatcaccgcattgaatgccgtgagttcgtcatctgatagcgtttcaagcgcccactcctcaagacgggaccaaccttcttcgccaccaatttccttagaaacatcagagaagcgttgggtgttagctgcttccaactctttagctgcgttggcttctttcaggaagaaggcttcattttgagccttaagacctgacaggtaagcatctaccgcaaacttgccaaaagcatcatacaatttctgcttggttgcatctgacagttcaaacttgccacctttggaatagagttccttggcaacctgcttggcatcaatgcctttctctttaaggctgtcagttacatcctgtgggatgtctactgttacttcatgttctccgaagaagtattgcacttcctcagtgtcggtcgtggtatcatctggcttaggttcaccattctctccgccattgtctcctttttctgaaggctgtccagaagcttctcctccggtgtcttcagtaggttgtgcaccagcattgtcatcttgtacagcagtgccagcgtcagcaggagcaccagtagtagcagcatcagttgttacctccttggtttctaccggaccctcttcagcagtagggtgagtggttgacggttcagtaaatgagaaagacattacgcctccttaagttcttgttgaattacacccggcacggccttagccacaccttcttcaagcatctgtgcttgctgtgcttgcatctgtgcttcctgttcttgtgccatctcttcagccgatttaaggaacggcagttcagcagagatttgaccacgcacccaatccatatagtcaggccatttcacagcagctaggacaggctcaggccattgtaatggcagtgacatatactgagcaaagttagccagtttatccaactcagccatgcgtcctaaagcttcaatacctgtgataatcacagggtccactaggtcactagtgaaggactcccctgcctccagcagaccccacatcgctactggcgattgcatagtagtagcaaagagggagtatacaccacccatgttctgctcaatctctaacgcatctcgctggatttctacagcagtaacacgttcggcgtcacggcgtgtcattgtctccatcataaagacaacaccgatacggcgagtgtatacctctagaaccgcgctaataggtgtgaggtctgcgtacttacctaactgtacaatatggatgtcttcttctacaccagtgacaacctcaccagtgccagagttaacaaagtggtcaacatcagtttgagcacccggacgaatcaggtacttgatatctgccatcagcgcagcaccacgggcaaccgcttcagataagaattggataacgaataaatcaccggagtaatcctctgcaagagggcgaccccaatcctcaccatagcttcgcttccaagttaatgggatgaaaggtagcttttctgatttgattttactcaccttacccacagggatatcatcagcagattgcttgagttcccaaaatccatcaccaagatacttagcatgtgtgtacagcttaacgctgtcatcttccttgcacttcttacctttcaggccaacctctactacagcacgtgtagctgggtcaaaggtacgtaaggctttctcttgtagcaagataatgtctaacaggtcgccattggtatcacggttaactacgtagtgatgcattgggatagcactgattgcacctttgctcggcttgtatagcatacagctgccagcaacaataagatgcttaaatgcttctactacagcaggccggaattgacgttgctctaactctttcattgcccgtgtttccacttgagcgaagatggtagctagctctgtcttcttcaggccacgctgattaagaaccttctcaccttgtgcagttaagtctacacggaagaaggaacgctgtgcagggaatagtacttgcgctagcttgttggctagatgattagttgcctgagcacctacaccttgccatccattctgcgaagtctcgttatcacctttgtcattcatcagatagggcaaggttaatttggagtaatgcttcgccctatcaaggaaagagctacgtttagtggagaacttctcccatagcttaggtatcttagaccgcttacctccatactccaaatctgtgctctgtttcatattacaccttcaagctagaagctaccggacggacaaggccgcgcttaccttttgcagatgcagtcgaatcatcaccacctgcaccaatttgaatatcttcagcttcagtctcaggcttacgctcaagctgctgtgctgggactttggcttcaatacgtggtgcatcttgagcaagaccgatagccttaaatgctttctttacaacacccatgttatctccttagaacttcaggttgtacacagtgccaaacggttcaaagccaagtcgcttatacatacgtccgacacgttcttcattaataccagaggcgatagacaggcgaacctcagagcattcattatcactagcccattgctttagggctttgatgagacgcataccaagtagggttcctcgcttctctggtataatataaaagagaatgtcagaggcaacccttacaggtgtccaaggggccaactcgtgatagccagcccacaggaaccctacaatccgcccttcatctacagcaacccataggaataaatcttctctactaagagatgcgcaaaggttatgtgcgctttgttctgcattccatgatgctgagtgatgggccactaccttgacttcctcttccacatatttattcccaaggtttataatctcaggaatatctaggaaggaagctggacgtatcattggaccaccagttgtgctctgacacaatccatgatgtaacgcttcacttcatcaacgattaactcttcatgagtcttagtcaccttcggagaagaaggcttgagaatcatctcaagcatctccattccttcaaatgaaatcgtcggtttcttcttcgtctgtaccatataattcgtcaaccttctcttggatagcttctacagaaagaccaagttcttctgcatcagcaagtaaagtatatggcacttccatgccacatgataaagtttcaaagatagcttctgctacctcaactgcacgagttgccttcatgctatcaaaagaaatctggttcatctttgtcatgtcttaattctcccgctttgggcagacgaatgttgcccttgcttgaatcctgaagacctttgacttcaaagattttaccaatgacattcaaccgtccgccatgtttaatatcgtggaacatctgttctgcatctgcatgagtccaccctttaccgagcatagctttgattgtcttgccccctttccacttgaaaatgaggttagctaccttacctttgtatttacctttaccttcttcaaagccaatacaagtaaggtcataagttaccttacggacttctttagtctgacgataacctttgtgtcctgcttcataatcgcagtccagtttgaatacagcaccctcacgtcctgcatctatttgctcttgcgcaaacgcttcaacttctcgctcattatggcaaggagtgataggaaggatagcgttgcacccgctaagatgagtgccgatacgacgatgtaaagcatcgtaacgtttgagataagaaacatcagtgaatccatcatggaatgccttaatagttaacatatcgaagaagtcgatatacaggttgtctttaatctgctggcctatgaagtcaagtggctctgtacgattagggtttaccactcctgacagagcttcaagataaacatcaacagccatagattgcaactcaccaagatacaacccgacaggaaatacactaaatgtcttttccaaggcttcaacatttgcgagcttcttaccagtacgaccaaagacggcaacagcaccatcattgcgcaccacaacagcactgaatattccatctcgtttcacctgtgcataacatggaaaagtaagtttcttctcaggaacttcaccgcgatgcttcaccagcatgaatggatgattgcggtggtcttctggaagacctaggaattggaagatgttcatttcacctccttcatcacacctttgactattgcctctttaaagtgtgctaagttagaaccatatgcacttaggtgccacattgcaccttcatcatcagaggtcaatacaaaaccgcgagagcttactttatataagttaccgaagtaccctctatacagtttaccttccatattaaatatcctcatcaatacattcgtgacgatgcttctggaataactctttgtagtagtctgctttcttcaggtcttcttcagtattgaacttcttacctgcacgcagacgatacttcaaagcattacccatgcaataccccgcgaattgcttctcggtcatactacgggcgatgatagtaattgcttctacgccatcaaagaactcgtagtgcttaggctgagttaccatattgttgtctaacttatcagatgcaagtttgaattttttggaatcccaacctgtacccctcacctcacgaaagcacaagttaatgccatcaatatcatctatggttacagggctatcagggtcaataccagcttctttgcagtattgattccaaggaatcgaatctttttcattacgaaataccttgtctccaactttaaaagatgttttctcttgaccacaagtacagtaatcataacgcttatgacacttcttacattcatagtgtgacatattgaatcctccattcactatacaatcaagggctagtgcaatatcatttggatacgccagccgataaagtcttacctagccctttgttctatagtgtcaactaaatcttgccaatccaacggttgtcgctattggtttgcatcgggacaatatgaggcacaccctccagaataaccacacaacctaatgctggcttgtatttagactcacgcccataggcaaatgcacgggatgactcatcaattaagcagccaccttgcacagcccaatactgttcatgtgtattacgtgcgtactccacagacatcttaccgtgcaagtgaccacacacaaggttcatacgctcatgcgctgcatctgctaggacagagccagcaggttgatgcttgaatgccacttgttcaccattcggcaactcaagaacatgtgtatgctgccaatcccactggtcgccacctccatttgggaaaaagacttcacggtaggtgcgaagatattgcactggaatacccttggcgcttgccttacggaagtgcatagagccgtgattagaatgacacaggcgcatcacagggaacatcttgtgcaacttgtgcatgaagacacgagccttctctagctccatgccagcactatccagattagggtcagagtcatggaaggagagggcgtgtttatctgcctcatctcctaagtgaaccactgtatctggacggtaacgtgccgcgactgctgcaaggaactctaaggtatctggatgctcataaggtgcatgagtatcagggattaccagtacacttcgatgaggcgagtcaggcaatggtacaatagccaaatcctcgtagcggtcaggagtcctgagcttacgctcttctttgatacgcttatcttcttgcagaagggtctggtaataatcaccattcttcttggtcttcttgaattgaccatgccagtatcgagccaactggcgggtaatcttcttacccacagggtgacacgataatacacgtgccatctcattataattaacattacctttctcgtcggtagcttgctcgattgcatcaagtacctcggagtctttgtacaagctgcgaagcttacccaactttaacctccttctttcttgcataagcaaggcgtgccttacggttcttagcctcgcgcttctctgcctccgtttgatgtttgtgatataacttatctgtctgaggcgtactatgtaacttccagtattcatatagtcgctctaaccattgaagctggaagtaacggttgttaccagccttaccgtaaccagagataacacccttaatctttccttctgcaccattgcagcctcggcatacaacagcacggcagaatcctgtctcatggtcatggtcaagtacacggtttataggagtaacagccttgagactgccgccacatagtgggcacttccacccttgcttctctagcaattccctcttataagctgctacctccgatgattttaatttgctaaccatttcgcatcatctccccacaagattgggttcttatcggctcgccatatatcacctttgaatcttgccatgtgagctaggcgaccacattcgagcatcaggtcaaaagccttgccgatacgataaccacctcggtaattcttaatcttaacttgtccatgtccgaacttagccttgtaagcaccaagcactgccatgtacaactctttctctgtcttacaatctttgagaagatcataggcgtatttagcaccacgtccaggtatgccagcatagttatcaatatcatcaccgataatcatctgtgcataatgaaacatgaggccagcacctttaaggtctttaacctgaccattagccttacggcgtagctcaagccaacccataggctctacccatttcttctcttgacccggctgaagatgccaaccgggaacaatcatcaaatccttatctaaggaaacgatgcaagtatcagagaatgctttatgctctggactaccgatagggaactcgttacctgtatcttgctggaagcggcggtggctgtcccattgtgcaatgctcatgaggtcatcagcctcttctccatctgccaagattgcaccatgaacctctaagagatgctctcgcaattcatagaagaacggaggcttctcggtcttacgttgacccttataaggcttggtgaaggctaggcgaacacggaagttagcttctgatttcgtcatgaataacttagctgcatcacactctgctgcatacacccaagagttgagcaaggagttcacacggtcacacgcttgcttacactcaggtgtatctttgattgatgggacttgtcctgacttaacacgagttgtggctcgtacataagtcatgtcactgattgtataacctacgatgtagggtaacatgtcagcatctattaaagcgattctattaccttcagttggccacagcaacaggttattgtcttccgatactgtagctccgaagtcgaagtttggtcgcatgtaggccactcctctaatacactgagtagcaccttgtctgctatggcctgatatgtataaccccaataacctaaatcaaacaattcaggaagggtgaatgttttagtgtgaaacacttctccatccagcaggatgattactttaaagtaatcttgcattaactttaagtcacgaccatacacatagtctgctactaaacgagatttaatagtcggcataattcattctccaataactattacgcaaaagaccctgcctacactaaggcagacagggcatcaattaaaactcttcttcttcgcttaccggagcacctaccggtgcagctaccggtgcagctacttcttctactgcctgagcttcagcttcttcagcagacttaacttctttcaccggcttaccagcagcaatccaatccagatattcagctacgatattagccttaccaatctgagctttgtcagcctgctcagggaagcaagcgcgagcgaactccagaccagcagcgaagttacccatgctgtcaatcttagcctgagcttcttcacgggtatcgtaagccttagtaccagctaccagttgatcagcttcatcgacgataatgaaagactcaacggataccagagcagcacctttaacaacacggtttacgatagtttcaatcttgaacatattaaattctcctttgttagttgtggcattatcgccgattaaaattcttctcttctatagtgtccagtaaataccggacaccgatttgtctcacacgtgagactttataaaactgtgttcacctgagcaatgtcatgcgccggaagcgatacgccgtggcgtttccccgtagctgggtcgctgtagttcaccacgtgctgtccgtcgcgccagatgtagtgcaggtcagcataaatctccccttcggagaaagagtggaaagtgctacctccgagcgttgtgatacctttcttgcagtgcagagttacgatttgtactttcatccttcctccttaatattccgcgtcctcatccatctccggtgcaggagtatcttctgcttcaggtacttcctgtggaacagactcaccagtatccagagatttacgattagctggagtagcatcctcgtcatctttcttcttggctttcttccactctgggtcttcttcacgagcagctttaatgattgcttctacgtgagaaccagcaacagacaggttcttaccacgaggtgtttcattaaggaagtattgacgcaccaagttagctgggatgtcatcaaggatttctttggtcagcttgtcgaaggtgatatgacctgtcatagacagaccttcctcttctacctgagccagtacaagcttcttcaacttatcaggcataccgccaaagcctttccagttaacatacttgaaagtaccatcatcattcttgtcgccagagccaaccatagttgcagtcaggcattcacctatgaagtcatcgaaaccaccaagcagctctttagggtcaactgcattcaggaacttagtcaaggttgccttgtcaccagacttcagaggcacagccatccactgttccatgcgagaatcatcttcattcttgtcgtcgtcacccatcaggataatcttaacaagaacaaagtttgctggcttcttaacctcagtggtattacctttcttaaaaatatcttggaaggaaccaacatgaatgatgccagagattactgcttcatgatcaccaacttcagggttcttaaatactttaccttcagccttagtaacctgagcaccaaaatcaaaatcaccacgtgccatttatttagtctcctattgtcagttagctttgtactgagcacaagcatgtactcactagaaagcccgatatagcatcgggttgtgcaagatgcacaataaggttcaacactttacaatcataggccgaactaagccgacctattgttctatagtgtccagtaattatttggtaagattgtctaactcaatctccagcataacaatctctttcttcaggctgtcagatgcggcttgatgtacaagggcgatggatgccttgttctcttcaaattcagctttcaggctgtcgcgctcttgctggtgacgtgccagcatctcttcaacctctttgacttggcgtgcattaaggtcatcacgagatacatagtagcggttatggcagtcaatcatttgagaactacgatgttcttcaactttaacttgctctgcctgtactgcctcgatgcgagactcaatagctttgatagccttggacttgaacttattagccagaccacgaaagtattgagctacaaataccagagtagttaccatagacatgtttatatctcctatatttacttaattacctatactaccttataaacctagattgtctaggcttccttctatagtgtccagtaaatcaatgcactactgtgacattacctacaacttgcttggcataaggttggatagctttaatattattaataatatgatgtaagaattgttcctctgttaaatgcttacaagtagatttagcgaaactaaagtgtcttctaatcatcataccttccttggaacgcacctctattactccagagatatgacctcgctcccaagccttaacctcaatacctatcttatggtctttagttaactgataagcagtgtatttaatcataatatttccttagttaagttatccataaaggccactcgtaagtgaccttgagtataactcagtcgtagttaccatcacaatccgggtcaatgccagagaaggcccagagtactaccataaataatatgataccaagaataataaaagcagtttgcattagtcgtaaccctcttcttcatcaggtatatctagtctcatactcccataacaagcaagcataaggagtgtaagaaagagagtgaagaataggcaaataatgtcaagcctatccatcagtgtgtttccttccagcttgcgccaatcttatattctcctgccatcgggcaacgcatcttcagatactgccctgcccaagtcatggcgtcggcaatgatatgacctgcacggtgataacggcgctggcaatgcaatacaccagcatcagcatcaacgctaacgaggtttgcagcagaccacatacgtccttcagaatccacatgaacacgtttctcctctgcatcgaaaactgctttcacagcagccttctctgtttcgaacccatctaaggtgaaaggtaggtcgtagttaagatacaagacctcctcttcaggaacttccatctggatttcatcatgcacgttagccacaccacaaggatttcccatagcatccaaagctacaccttccttgcgcattactgcaaatgccttgactaatgcatatttcatacacaaagagccagtcatctggagtaatacgttaagcatcgtgtgctctttaagttcaccaccagacatgcggatgcgaccccaatgcccatcaggtgcttgcaggtagccaaacttgttaccttgtgcgataacattctcacgaagacgtgcaagagacggtagttcaatctcgaatcttgccacaacttccttcatttcttcctcagtaacaccgcagactgctgcaaggttggctataccagaaccatagaggaaggcgtatataaacgtcttcgccatatcacgcttaggaagaccagccttcatctggttatgcgtatgaatatcaccgtgcagtacaatctcttggtactcagggtcattcatgaagtgagacaggacacgcagttcaagacctgcaccgtcacaaccaaggattagcttgcctttccctgctatgaataaatcacgtaaaggatacaagccacgggcaggaatattaaccacgttacgatgacgcatacggaacgtagaagtgccaatactaatagcaacagctggaacacgccactctccgtcatctttgtcagacgtaggccaacatccgtacctctcgtagtattgctgcgcattgattcctagctccttgttgaatgctacaggtacaaggccgcgacactttcgtacaccagcctgcgagggccacgttcccttctcgttgaaggcttcaacgtcaccacggttgagtatctgaccacgacgggatacgagtatgtaccatgcagcgatacccaagcaccaatcagggactgttttaccttcacgtgcggctctttcttgccataaagtgagggacttttcatttatcttaccactccaaggttttggtaacactccgtgctcatcgagatgagcttgctcggtatcgttaaattcaacacctttccatccatactcatagagcacttgcttaactgtatccctgttacccaagggaatctcttcgaaagtaacaggcgagtaagcgccaatccacttgatgcttggcgtgtcattacggtttcctctaaggtgaggaaagtctttcttgacactagccgaccaatcaccagacttagtagtgacactccatactgtcttgcgatctcctcgtctctcggcatgaagaaagtgtgaggggtcaaggacagtaggtatattgttgctagctccatactcatttgcgcgttggcatacttcattcttttcttccggtttaaaaggtttagacttgatacgcataggcatgtgagggcggaacgctgcgactgtctcatcaatcttagcgtccaattcttcgcatcgggccaaagccttgtcgatgtccagacggaacccgcgctcggcctgacggctcatctccagcgccacaatggactccatgtggaaggctgtctcaatgcctaggcccgtgcgtttattcacgccacggcgtttgtgctccatccattccccgttaaagagccagaggaacaagtcacgaccaatcgccacgtcctcacgtacacggtgaaccatgtggtcagttagtttagaccagtcctcgttctccggtttatagcgacctatacggatgccgtgcgcctcaattgagtgaggggcgacgttacccatacctttggcatatgcttgcggaggaaggcgtctatcggggtttaacaggcgactcatcaccagcgtatccatgactcgcaccggacacaggtcagcacggagtctgcccttaccgcgcttctcggtatagttaaagcctttccaaatatcagggaatgctttctcaaagagaagcccgtcataccctaggaagttctgtgacacaatagcttcacaatgcttcaggaagttaacaccatcaaccaaggttccgtcttgatgaccttcccattccttcaggcgttctcttgcttcagggtcacgcatctcatacgggtcaaagaagagaaactcctcggtagtaagcaaatccatgcagcaaatgatatgcacatcttcacggtgtccatatcggatagcgtcaaggagtcctttagcttccgcatccatcacgaggatacgaccttctgcctccttcttccaatcaattgatttcatagattgctccaaagtatttagccctataaccaagccctaataaagaattaggtgttagatgtgggtagttataggctaattcattgtggtacttgtcaaacaaagcagcctctttcttagacctacaatgtccacacttaccatcaatacgactgcgataacctttaccgcaagagcaaaccttactgactttaatagttttcatacattgcctctgtttcgtagtaatcatctgaacgttctggttttggattcattgagtcatagtagtcccaatcagaatcataatcacgtggcataatgcacctccaatcaacatgataaaaggctgtctcacacgtgagacaacccttgacttatcgactgcgaatcttacgtttcacttcactttccttgataacctgttcacgagtgagactattcttcttggcctcagccatagttaactgtgcgaacaggaaggcttggttagtaatcttggcttgcaggtcttcatgaccatcgaacattctaagactatgtttattctgcatatttcaccatgaaactgccaatgactttaaaatcctcacggaattgcctttcagtccaatgaccaaaaagttccatttggaaacttgcactactactagcacctattaatgccaatctttttgaagtacgataaggcttaacgccatttggtgctacaactgcatagcatttatgaggtccacgcatataaattaataccttagtcatgattaactccttagatattcacgtatgtttcttcagtaacgataggcaggtacagtaattcttcaccatttaagatgtgaagacccttcaacccttgcttacgaataataccttctatagtgtcggcgaaatgatcattagctacacgccgtggtgtgccatgctctgtgattgcatggtcaacatccaagattcgcacaggcacatttgggtgcatcatagcttcaccaattttcaccatagcttgtcctgtggatttacccaatgcacgagtattgaactgtgtaacctaatgcagtgccacattgcttaatcatctcactctgagtcttaccagtgattacattgcgacgctctttcttgagtgtggttttcttttctgccatgtactctgctagtgtttgaggaccagcaccataataaagaggggctaggaaattcttaagcatctggcgagcacatttatcgcaaacctcatcatgtatgcacttacattgattgcttacctctacaaccttttcaagatatttatgtgcggttttcttgtgataagaagccttaataccatcatcatattctacatgatacatgttctcacttacacgagccactacaccacggcaacgataacgacgtgaggcttcattgatgttacgaacataatcacctacattcaatactaatttatacataatcaatctccagttatttaatgtacttaataagagcctgtctcacatgtgagacaagccctgataaatacactagataaggcgtgttacaataaagaacattgacatcataaaaccagatgcaacgataagtttcactgctttcttgaagccatatcgtgcagcataatctgcgatcacaagcatgaataggatctcaataccgatattcaatactggtttaataatttccattaaaactcctgttcatcgtcaaaagttgtctcttctatagtgtccggtaaatccggcacttcttgttgccttgcttcacctgtatcaaatgacttagtacgggcttgtggttccattaaacgtccggtttgaatgtcacccttaagcatgaccttggttccagtgtagataccttggtcgcggtctttgacacatgagatgtacgtggtagtccgttcatcaagcgtttcagctcttgtattacgctcaatccccaaggcgtaagatgcccagaatccgatagcgcctgaacctcggaagtcagaaaggataacctcgccaccttcttcgtgttgggtacggtttgccggaggacgtgtaaggtgtgatacaaggaatatagtaaccgggtgtcggtctttgatagtaccaatccgcttgacgcattcatcaagtgcaccaaccttcccaccaaaagcacgctcatctaatttaatccccgttaagttatcaatgatgatattagaaatgcccatagcctcaaactctaggcaagtttgctctaccttttccatcgaatagtcaccctctaggtcagctacaaacagcttacctgtatcagctacataatcaatggcggcgttagcctcttcctcggtgtagtcgaacacctcacggtatccatcttctttcgggtcgttggttggcggtaactcaatacgcttatcaatccacttgccgataaaagcacgggacaccttgaccatcgggtcttctgtagaaatgatgcctacagattcaccgtgttcttcaatgaggtgcttaactacttcacgaaggaactcagtcttacctacaccagagcctgcgcctacaatgataagttggttcttacgaatacctagcgttaccttgttcagcttaggccaaggccatgatagtccttgctctggacgtgcagccttgagcttatccctttgagaggcgatagatttaatctggctaccaaagacttcatcagatgacttggcattaaaccatgcatcaacaaactctttggccttgccagccatcaatgccttgttagcatctttgcaaccagaggggtattcaaggatataggatttgccaggaaacaggcgagccgcttgctgattctgcttctgccctacctcatctccatcaaaaccccatataatcttcttgaattgggcgatatgctcacggttttgcactatctcttcaagacaagactcgcctttgttgacagaccatacatggtatggctggccttcccacttagtacccttggcagaatcaaggagcatctgctgcgctgctagtgcatcaagttcaccgcctacaataagcaagcaatcctttcgtctccccttgtctaacacgtgagacaaagtgttcataccgaaaagatcttgcataccaaagagtttacctaggtgtccgaacttaaaatccttcggcaacgtccggcattttgctccaacaagcacacccttttcatatcgtggataatagtgacggttgactcttccctcttcatcgtgtccaacgcgcacatcgtacattgctgcgatgtcacctcgaatgtgacgggatacaaggttcttacgcttaagcgtgaggaaccattcaacatcaagtttccactctgcttcttggtctgccctttcttgctcattcatgacctcccaacggtctttcatacgcataccaccaagagcgatggcgcgtagcttagggtcgcttatcttcccttccttctccatttctttgaattgagaaggtgtatatttgatattgccagtaataggtaactcggttatctcgatgccaccctctggcttatggtaataaggcttcccattatcatggaagtgaccacggttacagtaaccagcgccatcctcaaatatcataagatggttgccagtaatatcatgtccattcttttgacaggcaggacacggtacattctgaataatagccataacttagaactcccacgcagcgcgtttagatgcacggtcacggacaggtttattcagcttcttgcctttcttctgcccttcttccatgtcaaaacggttagctttacgggccatcttttcgaagttgcgcatggttaaatctccaaagtaagttagtcttatctatactgtccggtaaatacgaagtctcacatgtgagacaacctagatctgcccttcctctaagtagtaataagaggaaggaagaaggtaataggtattcctagataacctatatagcctttaatacctattacttccttttatatcctttatcttcccttttctttcccgtctccgacggctatcctatagtgtccggtaaataagtctcacatgtgagacactttatgttaatgaaatgttaccggtagtaggtaaaagaaaaggccactcccgaaggaatggcctattaatattatgcgaagcaatagtcagatactaagatttcgttaaggtcaaactctccttgctctggcacttggattccggtgtctactaaccagcgttcttcatgctcatctaacaggctttgcagggcattacggccttgatacatcttcaccatttctgcccttagactatcacgtagatcggctgtacggcctgcgtgagtaccgaaagaatcatggatgactgcgatggatgtaatgcccttgtcaacgaggtcacatacagtcaggatgagatgactagcatcatgcccgtgaacaaagttaggagcagcagcgcccatcatagccgtttcatccactacatcagtctcaatctgtagactcatcttgatttcacccatcaagcaagtggatacgcgtagcatgtcggtagccattatcttttgttgcaagatgaaaccagtaggtaaggtgtactctaacccttcgtttcttttagctgcgaatcgtgcaagctggcgaatcattttcatcgccactataggagctttaacaacctcagagatagaaggccaaattaaagcagtcatatagttgtaagctgcgcccggtgtcaggtaatctttgcggtcattatcaaaagggtgaacaggattcgccgtccgcccttctgcaatagctcgttgggcctctttttcttccaaatcaacgatataatcaatcactgactcacggcaggttaagcgggtggagccgtaaggcaaggtcattaccggctttttggttaagccgcgagtgatacctatcatatcccatgcgctagccatgctacgcagttctgcacctgtaagtgtgacgcttccagatgtgaaagtctctgcatcgtctgcattcatgtaggcgtaattcttctggataacaacctgcgcaaccgcgccataaatatcttgagggaagtcagaaggcttaaggtttactgctttcgcacctacttcatcgcgtaacatcgcgctatagtgctggataccagagcaactaccgtcttgatggacgggtaggtgcgtcatgaattggtcttgcgtgccttcatccagtgcatccagataacgcgcatattcaaagcaccatgcaaggaagccgtaaggggaatcagcatttacccattgagtgaaggtcagcggatcggctgcaatgtcgcggcacatgtcttgaaattcgccatccagcacgttagaggtgcgcacgtcaaaagttttcttatcccaaccccagttattcgccccgttcaccaaaaaccacttaagcgcctcagcgctatcaagacgctgcccttcggtaaaacggagcaatgccttgcctaagtcgtttgattgcggcgagagcgtgctagattgcgcataaacgcgtgaacggctatccagtgcatatacaaaataaatagcgtcaaactggctgtatttacgggcctgtcctaccatgcggacggtcgccgccgacttgctgccgcgcttagtctcagcggtatacagtttagtacattcacccttccagttgatgaaggcctgccattgctccggtgttagcatctctttcagttcacggcctcgcaggtgttggaactcaagaggaacagggttagctggtttgttctcgcggtcaatgagcggcttaaaggaaggtacaccataaccgaggtctagacgaataacatcttctactacctgcaatacttccttgttaacctgccacttagtggattgcaatgcattaacagccttataaaccgctggcatttgctttttagtcagcttacggacgtgctcacggttaccttttactagacggatgcgacttgccaccttctcggtgtgaaagccaccattaaacggagaaacccacggacgcggaggaataacgcaaggtgcataggctggactcagctgagctacgtgctctttaaatgcagttatccattcacccacgtgttcgctagtctgtaagtagtaaacgccatgcttgccaccattagtgcgcaaggtgcgaagaaagacaggctgaccattgaagaatacactattttccagtatttctagcaaggtcataccaatttgtagcaaggtatctttaggccacgcctcccagcgagagaaatcagcgtcacggtcagctactgacttctcagccacgaccgctacgttgtgcgcatggcgatatgatttagtcttacttgccttaagtgacttcttaactttctcaaagtatttggcggcgtgaccttccagcttgctaaaacgtacttggtcctcaatgcggtcagctacattcatggctatagcctgcaaggttacatccgtgttcagcatatccataacgattttcatagtgatatatgctgccacttcgttttctacgcagttaatgaaagctaatgcacgcggtgcacggcctcttttaccttcatactcttccttgtatgcctgaataccttcagccattggcgcgattaactcggacaataagcggcgattccatgccgtgtctgattcgttaccggatgcaatctggcgttgttggtccgcttcaaagcgacggataccgccgttaaacatttcttcttcaagttgaagttgaatagcgtgtaggtcttgcatcttgtttactcctagtgaaaagaaaccttaataggtgacacctaagaagatgccaccgataaggttacttagttaattcttctactgcctcagagattaagggccatgcttcatggccttcgccgtagcctagcttaaccagttcgcggcgtgccttgttaactgctgttttcttcgttgcctcctcagcgcttaaacctaagcgagcatagaagcaggaagatttgaattgcggcagcataggcgcggctgctttcttgctttcgcgtgcgctgcttaaggaggcaatgcggtcattagctgcctgtaattgctcggtcagtgctttaatttgtgccagaaggccagcaatagcggtactctcggtgttagccgtgttatcccgtggcgctgcctttgtgtcttcctgcttgcttttgtcttcccacggtgcggattcgtcgttaccagactcacttgctggcggcacactttgtaattcctctttcgccttctctaatatgaaatcctcaaaggttgcatgtccttgcatagtttctgcggcctcagtcgcgttctcctgcggttttaccgactcaaccttagattgtaccgtctcggcctttgtctctttcttaggatcaatcagggcgtttacggcgttagtgtccagcttgccctctgcggcgagttctgcggccttctccatgatcatattttcatcagcgaaaggaacaagcgccagcattacacgcatagccacacctttaaagcgttcgtctccttcaaagacacgggctacactcatcagcttgtagcattgtgctttcttgatgccaaactctgattctacataagctaaaaagtctttttgaccttcgaaatcaccgcgtaattcattcagacaagcgccaactttgatgtaagaagtgccgatattgtctaagtgctgcttgatttcagcggttgcagcttcacgaacagacaggagggtgttttcagtagtcataatagtcaccttatatagtgtaagtaaatatcacatagcccactcaggtaggctataggctagttacttgatgtaatgccacgtttctataaatgcatctttgctaatggcgcattccgtgccgttaggtgcaatgtattctacaagcccacctcttacacaaaggtaattaccgccttcctttcttagtttgcgtttagctttatcaaataagaactcacggtaaaggtgataggagcaccagcttaagccaataagagcaaatgccataatgatgctatctaaatccatagtcttaactcctagtaagtgaaagtttaatcaggcgctaccgtagcaacgccttgttaagccttctcttatagtgtcagctaaatagtttgtatgtagtgcctagtacttcctcacgaatttgtgcgaatcgtagggaacacttcagggttacaccgtctgaaaagataaagttgtatagcttttccatcttattcttcctcttcttcttcttctaaatattcggcggagttgatgtattcaacaatcatatactgaacacgttcccatagatcaattgtgagttgctcatagatacgggcttgcaatactaccgttacatccttagtgtctggcatcaggccggagtcttcgaagaaatgatcaattccttcactcgccatcacggagaagatgtcagcataatagattggtacagcactatccgccacatcatggattgcatcatgtgcgttatcaatacaatcaatagcatcattccagatacgttcaactaatgcagcatgagcgttgttgtaaacctgagagtaagtcatattagacatagccatgttattaatcctcatttagttagttaggttacattatagggtactcaaaagaataccctaggtttaacctatccagactaagaagctaccatctaaattgttaaagagcttggtttgcgccttgataggctgactagtgccagcctttactttaaatcagtgagaaacagccataccactctttgaagctagattggttttccagtggtaatatttcaagtttaccattgaccatacgttctacacaaattaaacctttcatgataattaccttagttagttagttagcctatcaagacacaaaccgtattgttaaagagcgggatgtttaaagacgtcgccgccttgatgcttaatgtaaccttgtatgccgtggctgtcaacagttaatttagagatttgtcgtgattacttcatcgtaatcgtaatcttcactgcctagatactcagtaatgacttggttgtcatactcagatactaaggtaactcggtgatattcagtgtcgtaatctatcaaatagtgatacacatcaacgcctacaccagcttgcatcatatcatcacggaagcgaatagcttcgctagctgattcaaagaatacctcatgttgatacattatttaccctccctcaactcatctatcatgttacggtattgattaactgtatcggtccaaccttcgttaagaaagcggtgatacaaggctaactcatcgtctgtaagcaattcgttgttacgaatcatgtagcacaacagagtgaagagaacggatagttcacggttgtttaatgtcatagttaatccctcattcaataagtaattaaccacggcatacataggttacactaagcaaattgttaaagagcaatgtaagcgctagtctcttcgtatgccttactagctggctactaggtgcctcagcaccgcctacgtgatgcatagtattacactaagattatcttgtcaacactaagttaccatcactaagaataagataggttgtctaacgtgttagactaaggaaaagcaatagatatagagctaggatagcttaggttgactaggtttctggtgttcctcctactgcatcttattaccattctctttctttagcggtctaccgaccgcgacctatttgcatcttatagctttagctatgcaatcactaagagaagacactaagtctgactaaggtacactactaagctgatactaagataagcactaaggttataactaaggtagtccactaaggctaacctaagctatccatcaaggaataacctaaggtacacatcaggctaccgcagcgacgaacgaagtgaggagcaaaggaacagatagcccacccacgcccaccctgtcaaacgctcaggaatggccctaaaacggcccgtgtaagccctaagcggttgcactaaggcaatcaccttgtccaatactaaggcgtgccctagcgcttcctaggcgttccctccgcctcccttgtactagacaaggagtacatcagccctgcccgtcgaagacggattccctcaggccaccctatgggggcaacccggcgagggcgagggcgag

SEQ ID NO: 3 - DNA, 38734 bp, artificial sequence
  BP753
agggacaagaagagacactcaaggtaaaccataggcccaccccaacccttagggaccctcaaggtcaaccttcggttgtctttaggcgattggctgggctttaggtacccctatgggggggggggggaactttaggtccgtacactgtgagatagtcactcagatttttatggtatattttaaaggaccctctaaggactccctaggccctctctaagaccctctttaggtaacactgatagactggcctatctttaggtatagaccttaggatagaccattagaggctctttatgggtatactttaggacttgactctatagggatgaagtggtgtgatgtaatcataccgctgaatccctcggtgagccatcagtctgtgatgaagaccttaatcagcacaagtaagtaaagagcaaacggtagactccaatgaactgaggtctccattaatagctgcgtaaccaagggcagcacaaagtaccataagaaagcggtaggtgactctatgccgcaataggttcaacaataagcggaacatgagtctcctcctttatgttggtctttaagttaaggtgatattaatacaatataatcaccattcttagaggtcactttaggtacactactatgcatactttatgcactctataagtattcattcagtatctatatagtaacctttcgtccctcctctccctatagtgagtcgtattaatttattgtgtcttttcagtaacttaaggaactgaccatccgtggtctatagtgcatccctatgcagtctcaatgcataaatcaccactcaatgaaagacgtaccataaccctcatcgtcctcagagtacacatcaataccaccaacggacatctcaatgatgtgtgtggcagcaaccgtaggacgcatcatgtgctcctcaaggaagtcagcaagtacttcaccttcgaccttaacggaatccaactgcatggactcacggagatactcaatgcctaacgcaagggcatccaatcggtcatcatgtgccagagcgcctttctcacgagtgatacgagtcatctggtagaacagtgagtacttaacgtcatgcttaccgtctacgtcacgagcggactggtagtctgccctaatgacctcatcacgaatgacaaggcggtgagtctgcatgactggctcaagggtatcacaaatacgcatctccttcataccacgagcacgaatctcttccatcacacagttgtggtgtttaagaaggataggactgaataccttgccaaacataccgtcaccgaagttactctcgtagacaaccgtctggactccccattgcttggctttcttagcgagcaactcaagggtcttatcggagtaaccatcacggaaacctccagcttccataaggtagatgtaaccgttgagggtatacagtacagcgtagcctgtttcatccttaccgcgaccacttgggtcaatgaccagaatcttctgttgatactgaccagagttgttggagcaatcgtggtacgtatgaaggtcatcacccttaaggccaacgttaggaaggtcctcaatgatgttctgacggttcggaagccactggtaatgcattggtgccttctctaagtctaaggccgctacgatagcgtcacggagcctcagagggtacttctcggcatcactcaggttagggttaagcatgaactgtagcgtaaagccagccttaccgtattccaactcacgctctcgaaggtcatcacggtcgaatcgcacagggtctgtaggagtcccagcaagaatctcagggttctcatcgtactccgcacgaagcattggtgccagacgctgagagtagtagaggttctcttcgtgtgtcctcggatacagggcaggccagatgatagtggtgtacccacggttatcctcaagttccttatagagagtcatctcagtctgaggtgtaccaagatagataacacgagaagtaggaagtggtttaagtaacgcagcgaactcctgtacgagagtccatagtttctcacgggcacccatagttgcactgttagacggaatctcaacgtcatccgcaatgataatgtcagcacggctaccagttaactgaccagtgatacctactgatttaacactaggagagtggtcgggcttagctgggcctacgtcgaaactaatcacagaatcacgctgtccgggtcttggctttagctcacttagaaacggcagcaggtcgatgatgttcttgatgaagatggagttagcgtctgcacgttccttagaggctgatacaataagtatcttcaactgtgggtctctccataaggaccacacaacgaacgcacaggttatgaatgacttaccgataccacggaaagcctgtagtatgaacttcttgttgtccccgttagccagtaccttagccatgtctatctggcacttagtaggtacaggaaggtttaacgccttccataagacgaacaggaacgccacgaagtcacctttcagttgcgccacaacgagcgcattacgattggcttgagcggacacagggttcctccttacttgatttcctgcttacgttgcagttcacgaatagtatcttgtaacgcacgaatccatgcgtcacccttttgggtcactgcgagaatacgcttagcatctcgctcgtcaagttcggctctaccatcaggctcgaatccacactgaccatcggaggttccggtagttttgattctgacgcgcaaccgcttattgtcgctacgcaaatcagaaataatcctatcagtgctcccttccagcgcggcaaggtcttcttgatacttagccgatatttcattgagtgctctttgagtgctcgctgtagcctcaactttcttaacgtactcattctgtacctcctgtttccacttggcgtccattgagtctgccccaagttgccatccccatccgaatagcatcccagcgagaacccaagggaccagcttacgtaaaaattccagcataatgcctcccgttaactttcagatttcacgtaggagcatctcgtatagacaatgacatccataaagaccactacatatagtggccttgagtatatcactgcaaagtgtaaatgtcgtcatcggttagaccatcgtctccaactttcgacttgtactcgtccagagcaccagcaaggccccccaagatgtgttcatcaggttgcagcttaccaatctggaacttatggcggtctaacagtttgttaatggcgttatagagttgtggagtccgacgctcgtcgtttgataaatcagcaagcatacgctgtgccatcgcagtgtccaacatctctaagaacgtaataaggctcttatccttttccatacgcatcactccttattggctttcttccagtcaatcatcttatcgactaccttggcaccaatctgaaccactgtataggcgatagcggcaacatagaaccactcattaagactcagcccgaagaaaagcctcgcagcgccgtcagccacacctgtgccaacaatgggtgcagccttgactaactcgttgttaaaatctaaagacaacatgtagcgtcctccctcaaagagtccatccgtggactacacgtctttccttggtataattattccagacccttcaactcagccatgagtttcagcaagtcctgctcgatgtcctccttagttcgcttctgaacttcttctggtgcatggaacgtctttccatcccatgtgcaccctctccagttagtcgagaactcaaaagaatcagttacaacaacagtccctccctctacaggtacatacagtccagacactggtccatcagtaaaccacataacgtcgccgttaggtccaatacctaccacccatgtttcttggcgctcatctagttcgtccatcaaggtataccaatcaacgtcattaaggtcacgaatctcgtagattggttttccaaagtaaaacccttcggtccacttccagttagtaaatactctcattgtccctccttactgtgacgcaatgattctttttgtgccggtatggaaaccaagccatactggtcttacaaagataccagcaacacccccattattaacggttgtgcctgtttggacatgtccagatggcgctataatgtcgtgatagcccccaccgtactggttccacacttgagggcctaggtaaacatcccctatgaaatgtcttcgaacccagtcgtcaaggtatccaccatcgtatgtagagccgtacacacgaccgtcacctgtgagcgtaccgccaccatgtgttctgaaagagccagagaccacttgccgcgatgcgttaatatccataggagaccaaaagctaccatctccgtcgaatgtccacactctaacgttaccgccctcatctgtaaacatgatgttccacacgttcttaccgtcaccttgcactagaataccttgatgccatgctttggcatctattccagattgataggaacgctgtttaataagaggaaagtactcgttacgggcaccatctggaaccgtaccccacaatggggcattctcattccactgtcctgcgtgagacctgtctccgctccagccagtctggatgtcccttatatggtatgttctactgtcaaacttggtgtaattattcccactagcctcatagactaaagttgaaaacgcacgtcctgtacctgttccacgctcaagtacaaagtcgtagaaaaggttgccagcagtatctctccaaagacctgagcgatataggtccccttgaacggtagaggataatacctgtactccttgacggcaaaagagaatccctttaaagtacacatctacacccactactttatcaatagcaccagcgaggtcgttccagttgccaagtttgtctgcctccgacttagctcggtctgcttgttgttctgccgaagtagcagagttagcagattcttttgcagagttcgcagcgttcacctcagattggtgagcagccgtcgcagagccactagcagaggtagcctgttgtgtcgcagtgttcttaaactgttcggcctcatctcggaaccccttagcctcattacgccactgattggtattcgaagcgttagtgctggactcgttcttaaagccctccgcttggttacggaaagtctcagcctcattacggaactgtaaggcttcattacgagcttgccacgagttctggttcatggtcttaagttgaccaaacggaacagcgtcacggtcatccacggcgttcgctaggttcacgatacggcgaccacgagcgtccaagtgaccatcattattgacaccaatggtatccgcagttaggtcacgggcctcttccgctacgtgcatcgtctgaatctgggccacgttaaggtcataagcacggaggattgagccatccgtaaagtcaaccaagcggtctgtagtggaggttactcgacgcaactcaatggtcgtataaccatcggctgtaccccaagccttggtcagagagatggtagtgcgtgtagcaaagcgatagtctgtattaatcgtaaggaccttacggtctacgccaataagagttaccactacgaacttacgggctagatactcaaacggaatattaaaatcacgcgtagagccatccagcgggtaagtcaaaacggtcttaattacgttagccatttgacctccttaagtaaatctagaatgctatagggagaagaccttctcctctccctatagtgagtcgtattatttccgacgctccttcaagttgacaccattggcctcataaatcttcaacacaagctgttgagtcaaagggtcgttaggtactaactcttttgtagagttcatcaagccagtcatgaagtcctgctcggtagccttgttgggagcattaaccacaccagcagtgttcagtagggtagcaccaacgttagccacaaagccagccgaaggcatctgctccagaaggttcgaacccatcgcacccattacctcccacgaggaatatggcttgttagggtctctcttcttcatggtatccttaggtagaatcgtggaacgagccatcttagaggactcgacaccgaacgtaccaccgataaggtcagccatagctaaaggtgcacccaattgagaactacgagacaaggaagcgtgcgcaatcatggttgggtccagtgctcgctctaagtactccttacgtttctccttaggcattccatacgctttgacgtgtgcagccatagcatagtagccaccagcaagccccatggagatgataccagtcagcgcagcgtcaaccgcacggctattcttgtagccatcatagaagagcttgatgaacttagagttcagcgacttgatggtaaacgatttgaactgcattaccatcttaccaagcgcaccaaaagcatgggaatcctgtaaggacaccttatgtggacgcagcatcgcttcgtctgcaaccttatcagcaagtcgccacaggtccatagccctagggtccatagagaacgcttgcttgtccttgatagtgtacttaccgtcctcaccgcgaaccatgtgttccttgatgagcgccttgattcctttcatctgttcaggcgttaccgatgcaccacggaggaatccttccttctcccagcgagtagtcttaccagatagggtggcactaatcacatccccaagcataccttgacgggcagcatcaagaagatagttagtggtcccattaagcatcttcgtccacggagaacgagcagccaattcctgtgtggaatacttcaaggtccctacgatgttcgcaaccatcggtcctgtatcagttgcctcccgcagtcgctgaacaatgtcagcacgtttaggtcgaatcaactggtccacttccttcccgaacagagacgcatggagttccttgagttccttagcggaaactggtttagacttatagagagtatcacgaagaatcggaataccgtgaccgagagcacggacgttgccagtagcaatcatcccagcaatctcagtaaggttctgagcacccatataggcgttcttagcgaagaaccctaagtcattgatagaacgcagcgaggtttcccaaactgtgtcgtgattacgtcgagcacgtccggtgagaatcttaacggtatccataagagcatgaacctcgccagtcttcttgccgttaccctcagcacttgctttgagtgctagaatctcgtccttaagttcctgagtggttttaccggtagaccccatgatagcaatgtcgccattgatacggcggtcatatgcaggcatgatgcggaacatgtcgaagtcccttaggtcattcacggcaaactgttgtccatcaggcatcgtgatagataagtcagagtcaaacaagttacgagcttcaaggaacgagttgttctcaatacctactaggccctcaatgttctcttcaatcacagaactgttagtgaactggtctgaatgagagataccgtatgccttgtccatagcgtacttctcaaccatctccggcgtaacttcctttaccccatgaacttccttgagcatctcatcaacacgcgctttaacctcaggtcgagacgtgtagctgttcaaccaagaacgggcaataccttcctgtaaaccttcggcaccgtatcgttgaatcataagtgccttagcgtgacggtcgtaaacgtgcgggacgtaggttcctttatggcgactctcagggaagatgcttacagccttcgtattaccgaagattgctggattctccatgagttcacgcttagtgtcaaagtggcgcttaatgatgtccattactatacgctcagacggagtgagaaccttctgtagttctggacgctcaatagccaatgccgctctacggtagatagtgtaacgagcctcttctcgtgacatcttagagccacccgtagagaactcagggtctttcatagcgtctgacattgctttgtacaggtcgttgtaggttctctggtcggtactgtggagtctctcgtggatgtcagatgcagtggctccaaacttacctgaggcacccgattgcatcccagtaggagaacgcacaaggtcaatcgctatcctgcgaatattggcatcgtcagaccctaaggtcttcaagccaatctcagtgaaccctgccagtttaacgccccacgccgccttctcagggtcaacctcagagaactctttgagtgtcttagggttgattgggttacttgcactaatcacagaaccgtcatggagtaccacagcacccttctcagtaggaaggtcttcatagggcacaccgttgtgctcaccttcaaacttcatgttttctgtgttcatccgagaaaggtcagtagagttagcgttacgcgctgtctcacgggcttccattcgcatcatagggccaatgaactcattgtcgaactcggcttctggtttaccacgtttgagtccagcagcgatagcgtcactgattacagacataccagcaccgaacacaaagccacctaaggcagcacctgcatagtcggagtcaccaccagccacagaggttcgaagtccttcggaggctacgttaagtgctgcactctcagcgcctacaacaagtgccttattgattagcttaaagcctttaccagttacaccgaccatcggaacgtagctcagcgggtccacaccagcaccaataacaccagcactcagcttagcacctagaccagcatcagcagcgcgggagtcagcctcaaagttctcgttggctaacttaatgagggcatcaagattctcaggagaaccaccagtcaccacgttgatgtacgcagggttcttaacctcggttcgaatcttctctaactcttctggagtccagatgtgagagttccagcgagtcggcgtaatggtgtctttaaacacatcaaaaccattatcgagacgaccagcacggaaagccatcccagcgactgagttggagagttcagcttcggcagcatctttgaatccgaagaatgttgagcggttgttataatcgtcaagcgtttctccgtgggtctcccaaaagtccttggcgaatggtttcgccggagcctcctgttcgatacccttaacgtcaaaacttgtggactcaggaagttcctgcgtaaccttctgcttatgcccaataccagcaagtcctacctcagccggaatgcctttaccctttggggtgataccaccgaatgcttccaactgtccagtcataggagacttagccacatccagaagattacgtaggtagtttcgtccctcctcggagatagccgagaagtcacccttagagtatgcctcaagttgaggattccccaagcgtccctcaccttggttatacgcaagggcagctttaagttcatccccatcaaacttaccaaccagacctgcaaggtgcttagcggcagcattgatagccaactcaggattcaatcggtcatcgtctggcccatcggtaacgcgcaatcccattgccttggcggttgccttggtgaactgcatcatacctaagggtccagtcttagacttagctgttggttggaatcgtgattctgtccaagcgactttacgtaaaaggtcataagagaccccgttggcatcagccgccttttggaacagaccatcataatcacttggtacgttcttatcgtacttatccatttagggcctccttatgtagcctttagttactccttacgtccatagatgaacttcggagtctgtttacgtttctctcggactcgtttagcaccagcttcacgggccttggtagcagcagtgataggtgctcgcttgttgatatccttcaatgctttctcacgcgctttctcttcaagtttcttctggttctcactccagactttagagagtagctctttgtcataccggattcgaacttgacccgtggtgtccataagataaatggagtcaccttgggagtacatggtaagttgcttgttggtaatccaagggttgttcgcaatgattcccttacgtgcttcctccaaaatatcacgaccttgttcccacgattttgggtccgagttgacttgcatcatgttcttagggattacacccacggtatcaccatcaacatcgtctccggtaaacgtgtatgtagattccttaaggaactttgacatctgctccatagccatgctttcgttacctgagcggtatttaacggagtcataaatcttacgagcagagtcacgaagcgccgctggcatacgggcaatctcaggtgcggttgagctattcagggcagactcgaacgccttatcgtcttcgaagcgttgctccttggagcgtttggcactcagtctgtcagcatcaagaataacctgagggtcgataccttgcttgtccatcatgtccaacgttaagaacaactcggcttggtctggatacaacgcagcaatcaactgtgggtcagcattacggattctacgtagagcgttcatagctggagtattgctaggcagcttaccgttaatcacagcggcagaccactcttgactagcgtctgttaccatggttccgatagctgtacggaatgcaccgtccttagagtcagcttgaaggtacttcaacttcatagcgtccttagcgccatctggaatatccatacggtcaatctcagctagtttcttattggcgtagttaaccatatcgctatgcttgaactccccagtgttctcgttggtaggcatgtccttgaagtccgttgagacccactcaccgttgattcgcttctggaactgcttgtcgattacatcaagtttgttcatcgacttcatggaatcatccagagccttggcctgagctttcgtccatgcattcatctggttctgaacttgctcctgtgccgagattaaccactgacgttggggtgtcatctgttcatcaggttgcaccttatcgagttccgctttgataccttgaagcatctcccacgcagtacgagggtcttcttggttcaacgcagagttaatctttaagcggtactgctcgttcaacttagcgtcgttctcaaactgagaccgttgcgctgtgaccataagtgcattccactgctcttcgcccatcaactctcggtaagtcgtagtggccccgttgagtgttaccttcttgtcgccaactcgcatcaggaagtcagcaccaccagcacggctggaagcatcactgaacgcttgaccaataagctgtgtagcctgagcgtcagacgggatagctccagtaaccagaccattgtcgatgtacttctcaaagaagtcagcggagtctgggcgacgaagcatatcagggtcttgaagtacaccgttgagttccactcggctgttcatgatggcacccttctgagcttgttggctcaagaagttatcgtgtgcaccatacagcgaaatgttacgctcggtaatgtctccgttgaaaccacgctgatagtcaacatcctcagggtcaatcccgaactgctcagcgtatgccttcgcgccctcttgaagacgactatggcgatactgttccatctcttcacgagtacggaagacaccttctttaaccttctgcataacgtcatcgtcaacgaggtacgcagcgttgcgaccagtcttgactcgtagtgcttccatagcgtatgggtcgtcctgatacagaagggtcccgttattgagggcctctcgacgttgctcaggagtcagcttacggataatctcgttagagcgttcatcagcaaggtcgcgtgctctttgctcctttgctgcatacatgtcagcacctgccttagcaaatcgaccaatggtgtccaataggctggacttaggttgctcagcttgtgttgatgcggctctgtagcccataccaccagcgccactccgtaaccgagagagtcccggttgtgccgcttgaagggcagattcaatcttactcatagttcattacctccccgtcttggttcctttagcggcaactataggtgccttagtggttgacttagagtcgaacgccccagatgcataagcactcgcagcggaagaccccatgatagccagtgggtcaagaaccatctgtagcttactcttctgtttctgttcgcctctgtagatttcatcaatctggcttgcagtactttgagtaccgccaagttgttgcgcgaagattgcttgatagtctcgtcggtagttctcagttaccatgttggcttcccgaatgaactgaccttctgtgactcgcttaatgcggtccattgaggcaccttcaagcatactctctccgatagccgctcggattgagcccatagcctgaaccttctgcatgttctgagaggtcaactccgaggatgcttcctcaagtttacttcgagcttgcaacgataggtcagcattctgaatgttcgtctgcttcattagttcgatagcttgacgacgaccagcagcggtctgagcggcaatcattttggcctgagagttctgaccactaatagcctgagcaccagccaatgcgattggaattgcagccatccagcacatatggttatcctcctttcgttattgtaaataattgaaattgaccatcctgtgtgtactcttcatggaataccgcaccgatagtcttgaggaaacgaatgtgggacgtattgccaacccatacgtaattccaaagagtatcatacttctcaagcatcttatcgcgatactccattattaacttacggaactctcgcttagcttttccactaagtcgccacacttggtcgctcgtaacgaaccagcattggtccccacagttacctccaatggctagagggaacccatagaggctcaacgtgacacactcggaagcatcagggaaactcggctcaataccagcagccttagcttcaagaatgtcatggtgagccggagtgaatacctcaaagtctgtacttttagtaggtcttataatcatcataagaaaaccctcccgtagtcgtattgttctccctatagtgagtcgtattaattccacaccacagggagaacattttaattaaataccagaacttctccgtaagtagtttccttcccagccacacccaatgatgttcagcggggtagtctcatcggacaagatagacacggtattgaacttggcattacccaccacagggaaacggtattgtccggtccctaagttcagtcgcccagccctcagggtgttagaacctaagcgagcaccagccattgtgtacttccagttggacgattggttctcaacataaatgtcgaacgtaccagactcctcatagttaacccacgctcggcgtaactgcaagcgaccaatgtcttccgttgaggtggacccatcgtcggcagtctgcttgatgagaaacttagagaactcatagacgaagttaatgttgaacccaatgtacactgtacgtccctctaagttgccgttgagtctcaaccatgggtcattgttccaccccgccgtaggttgctcaaactctgtgatcttaccatcaggttccagtacagtgattttgcccctcccgaagttggcattatagatggttggtatgtggatggaagtttcgtaggtgtcatcgttgtacgttccactaggaatcgtgtagtgaatcttcatgtccataaaggcacgatagggttcaccttgtaagtcaatggcgttcttcgtaaaggaaaccctcgcaaggaacgtattgaactcgttacgtaggataatgaacatatctgagttgatgctttgacatgccaaaacctgcacgtttgccccaaagtcccaatgggaccacgactgttgccttaactcttcattcaggtacaggaatttgtacatgaagattttgctagggtctccgtgagatagtactgaacagaagttttccgtaccactaccacaaatactgaacacaccattggggatgtagttaggaacgtgtgctgtaatgtcctcagcgttcttaacggaacttacatcctgcacagcgtagtatctgtggatggacgtgaagctggacctcggactagcaaagtagacatttcgcccaatcccaaaaggtctcgctcggtcctgtacgtcaaactgagtcgttaggttcaactcaactgaccgtgacgtaagcgtaccggatgccgtcaaaacgaattgcgcttcgtctgaccaaatgagcaactcttctgagaacggaactgcgtacttaaggattgcgattcggttggtacttaccgctacgtcgatagggtcatcgtcactaaggttggcaactgacgctgggaagaagttgaagtacttcgcagtcctgctaagaatgatgttctcgccactaaggaatccgaggcgatttcggaagaagaacacatcattaatcgtcgagccgacaaacgaaggataagggttcgtgtcaatatcaccgcatactctagggttccacgcgattgtcttgaactcaaagttaccgtcagatgcccgaatgagggcgtgaggcatcgtatcgtgtgtatagtgtaatttggtattccacccaacaacttccttccacaccttcctgctcgcatcatactgaacatagtactggtcagcagatttggacgcatctcctacaatcttcaccatgtagccgtcaggagcattaggcggtagtttggagaaggactgagcatagtgagttacagggttaatcaattggtcagcataaccgtcttctgtagacaaattactaacctctccgtttgccggagctatcacatgaatgaagccctgtccaacgttgaatgtccacccatgagggcctagggtattccttagctgatttgctaactcattagcaagccactgtgcgtctgtattgttaacatgttctggtgccgaaccatttgggattgtatacgaagcgtaaactgttccgttaataagaacctttaaggtcctcccgtattgtcctccccttacgttaatcaaagcgtctcctttatctctgaatgtgccaccagttgagatttctgtagactcggtgactgtgacgttcctgttcacaacaaacgtgtagtctgccacagtgaccatcctcaggtcattccgtgggttagctgtctgtacatatgctgcccctgtagggaaacgcacttgtttctcgttaccagctaaatcaaaaactcggatggtacttccggtaaacactgcatagtaccgctcgtactcgtctcggttaataaggtgaatataaggcgcttgccctaagtcaccacttcctcccaatgtcttaaggaaaaccataggtggacgcttttggaggccctcggtctccgaagaccaaccgttaacttggcgtgacccttggtctggataacgaaggatgtcaggctgttggctgataccacccttcaagttcttgattgattggctaatgagtgccattagagcctccttatttattaatcagcgagtcagtagaccagaagtgaacgcatcgccatccagcatattgtacccaccgtagtccacttcgtactccatacagagacgtctagcctcatcttcctcttcttggagtacaccctctacttctggtgccccaaagaatcggttgttgaactgacgggaagccttggtgacaatccagtagcggaagcattcaggcatctcatcgtagtctctgagacggataatgttcacagtaatgccagagtcaaagcggtctgattgactcgttcggtcatacacatagccacctcggttgacatagatggattgaccggaagtagccattagggataaatagtcatcgctgtacacaatcaggttggagtaaacatcaggtaatagcgttataccttcctcaatgttgaacgtccatccacgagactgaatctgtctgttaatcttgttgagaatacgccgagcgttcgctacgtctgcgttagagtcaccctcaagcgtcgataccggaggttcaccgatagatgccagaatgtcgttcacagcggataactcagcggcagtctcaacgttcatatcgtatgagcgcatatagtttctccttatgaagcaaaaaacccctcaagacccgtttagaggccccaaggggttatgctagttattcaccctcaccagcagaagccaactcagcttcctttcgggctttattggcagcgcgtgtgcgtgcagctttctgtgctggcgttaaggtttcttcggttgaagtaacactcacctcttcggaactagcagcgaccgttgaggccactccttgcattactcccccttgaaaaccaccgcaccagcagcttctgggcgcagaccaccgtgacccattgcgtacttggcgataatctggtctgcttggaagttagcacggcgagcgcgttccagagccaaatcacgcagcttcacagtaccaacggcagagcggtgcatgaacaggccgataacgttgtcctgtgcgaccttgttgttaccaccaacggttgctgggaatgcgtgcttctgaccagttacaccatcgcgagcagtaccagcgccaccagaggtcaggtgtggaacctcgacaacctcaaagcccataacgttgcggatagaacccttctcagggtcaatcagagcagcgtagtttgcagcgttcggcatcagtgctgccagaatcgcagagtagctatctgggtcacagtagaatacgcggtcagcagccggaacgtagttcttggtcagagccgcacgagccttagtcaaggcagcgataatctctttacccagagcaacttggtcggtcagagcagccttggtctgagacgcttcgataatcgttgcagtgccgagaccctcaatgttctcattagaggcgctcgccaagttacacaggccagcaatctcagccagaactgcaccatcggcagccattgccagagactcacccaactgggatgtgtactcagaacgaacgtcgtagtggttcatcgcgtcctcgatatcgtaaatcagaacgtcagccgtcaggagaccatcaatggtgattaccttttcggtgtgcttgatgtctttacgtttatcgtcgaggttctcacccggagccagatatgctgcctgagtgcgacccagtacagggaactgagcagatttaccgctggagatggagcggaccatgtgtcgagaagtggtcacggaggtacgagcgaatgcagtcaggacttcaccaccaaatacctttaagaacaacgccagtttgtcagaagcacttgcacctttaccttggttagtacccagttgctgtccaccagtcatgttagccatatgtgtatctccttcttaagaaagttaaacaaattatttctagagggaaaccgttgtggtctccctatagtgagtcgtattaatttcagagtctatcagaagttagaatcgattactttctgttcgacttgacgacgatagttggcatctgtacgataccgagggtcactcatagctttaatcatctcgctacggtccgcaaagccttcacgcttagtcgcctgaggtttagctggaatagcacgattggtcacactacgagttggcttacgcccaaacgccttagcgcgagactcaccagccaagttgatgatagccttaacggtcgctaagtcacgattggtcaacgcattgtccagcgactgtgcggcctcagggttgtgcgtctcaaggtgattatacagtgcgtcaaaacggtcacgaccaccagcatattcaatcacactgtttacgtactgttccaccagagcctcttgaccacggatgtatgagtcaatgaaagccttcgtgtagccaatttcagccagcttagcgtaggactcagcggacaactcttcgttctcctcgtactcacgctggattgcctcaatggtctcagcactcatgccacgctcggcagcaatgttaatcatctcttggaagccctcttcgtgctcaccaagttgctcagaggcagctaccagttcttctggagtctcacccagcggtgtaaactcttcggaaccttctgtgccctcgaagtcttcttcactaccagcgtccacatcggtcggctcagagccatcgccaatacgaacctgaatgcgcccctcatcgtcctcttgaccgaatgggtcagagttgtcatacaggtcgcgttctgtttccacttcgtctgacgctaactcgattgcatcatcgccatcacgggcagcaacatcaagagccagcatattctgctcatgttcctcaacggaaccaccagacatcacagcggagttcacgccaaaagatgcatatacgtctgcattagattcagccattattattgtctccttaaagttgaactatagggagatgcaacgaaggtccgcagtacggattgcctcgaagtcttactctccctatagtgagtcgtattaaatgcccggctgtagacctacggaatcagcggcagcagccatagcctcaggtgaagctgtagcctgtgcagccataccttgagccaaagcagcggcaccattatccatacccatttgcatagactgttgggccatcttctgttgcttctgttcttcggtaagaaggataccagaagtgtcaatgccgatagcgttcgcaatgcgcaacttaatcatcgcaaggttgatgtcagggtcatcgcgcataggagccagagcagcccacgcagcgacacaacgctccagcttatcaaggtcttgaccacgaccaattgcttccagacctgtactaatggttggctctacggcttccttaggtaactcaggaatctgttgcgtggcttgtagttgcttcaagagcactcgtaccagaggcaattgtaattcttgagaaaggattgagtagacaccgcctaaagtatcttcaagttcagaagcgacataccgaatctcttcggcggtcacacgttcccctgtacgctgaaccgcagagttcaacataaaggcaaacgaaagtcgagactcaatagcatcgcttacagccttagccacagtgaagtctgcttgcttctccagttggaggaacgagatgtcttctggacgaccagtaacgaagtcaccagtctgagctttggtcagtcggcgtggctgggtgataccagcaggattcactaagccgataaccttagagctaatcatggacatcttaacgatagcctcttggagattctcaagggaccgtaagtcaccgagatattcctcaatgtacgaacgaccgtaggattcaccgtccagacgaaccattcgaatcgggatgtatgggcaagcctctttaggataagacccgtcggagccttgtacttccataccttcaacctcttcgtagcggagatactcacctgattcttcgtccagatagatgtgagtgtacacatcaatggtctcatcaggtttcttatccccaccttgaccttctacagccttacggacatcctcagggagagcaccgaaagctatctggtcgcgagtcaccatttgcagaacgttgccgaatgcgtctcgttggaccacataagaagacaatcggtacagcttcatgggattgtagtttgacccttctggttccggtaggtacagcaggacgttacccgctacgactaactgcttgagagcctcaaagagagtaactcggtagctgttagactcaatgtagttcatgatgatacgctctaccattgagagaccctcatcgaccttagcgagtccatcggggtcattcagtaactgtttggcctcatactcagagatggtcagtttcatccacgtttgcatcgggaagagagccagcatgagcttagaggccaagttattgagaccgcgagcacctacagcttgccacggagttgtgtaatctgtagacgcgttatcggagtccttagggaagagggacggaatggtgtactgagcgcagttttgagcacgagtctcataaggagcacggtcgttctttaatcgctcatagaccgactttgcgccttcctcggctagacctgtacgcttctcagccatgtgtcacctcctgattaaatattgatgccgccaccggagctacgggctacactcaaggacttcttaccgccagcacgagctttcttacgtccgctttcggtctgtgcttcgtcctcggtggagacctctttctcaggtacgtcaacaatctgtgccgctggggttgcggctggttgtggcacttcgactacctgtgcttcaccagcaccaccagccagaccactagcaacctgtttaaccggacgagccacttccttaacgactttcttaacggacttagtgactttcttcacggccttcttaattttcttacccataacttatacctccttaaagtatacacgcattgtctcgccttcatgtttacagcgggacacccaatcgcaatcgtggagttctgcaaggtatttaaagcgtttcgctaggaatcgctgtaagcccttagagtctgcctcaggattaatgacaactgacgttacatccagaatatctcctttgtggtgaatgtcacagcttacacaccacgcgaagtatgctacatgttttccggtagagtccagaatgtactcttcacgacaacctgacatgtccataacttcgtcaacgtagaggctgtatcctacaaagtgtccttcgaatcctttaggcagcccaaggtgctctaccgtccaccggattgcacggaagcgacttttggcctccacacatgtgaactcagacatcacttcttgcctccgaatgcggatttacggattgaagatttcatacgagcggaaccagtattcgtagctttatacttctctacggaatcatcgcgttcgaccttgaggtctttgcgtccagacacttcggtgccttcggtatccgtctcatcagaagacccaccgaactccacgcttgacacttcttgggtcagaggcgctggctcaacggctcgaatctgattggtatccatcttcggaactttaactttaggtgagaaacacataaggtcaatcctccccatcatctcttagttgttccttacgtagctcaatctcgtcaatgacgttagaggcatactgtagaccctgaatgaaacccaagatgtgggcctcactacagccattagcacgcataagtcctatatgaccagacgcttcgaggtacgcatagttgaatcgaacctgtagatactcagcggttgcacgaggtacatctggaatatcgttagggttcttaagtaaatggttaataggtgttaacatgataaagattcctcttagagttaaatcttaaagtgataatcataaaggcccctatctccctatagtgagtcgtattaatttagggaccttgagtttatcacttagcgtcgtgtaacgacttgattatttgggctaggtcccaaaggccccacgcaatgaggcacactccgagaccacaaagacccataccgatatacgctacggtctccacaggtaaatctccttgtcgataaagttgtactcgttgaaccgtaggattcgagccatctggccctgcttgatgatatcctcttcggacatgccagccttcgcaccgatggacttaatgcagtcccaaagcgtctcatgaggctcagggtcgcgtttaacccacttagttacctcctgccccttattcttaccagacttaagcacagaggtcttaggctcggtaatgaacgggttattcaagaagtcctcagcggtatcaccccatccggcaatccctgagtaaccatcggtgatgtcgcccttgattgtctggaagagatgccaccagtccgctgattcttctgtctgagtcaggatgttaccagtggtacaccacaggaagtcacagttagggatggtcttaaagtctttatcgcacgagatgattacagccttacgagcaccgaatgcagacggattggaagcaataactcccataacgtcatcaccctcaagcatcggctcacgaatgcagtagaactcttctcgttcgaagagagcctcaaggaactcaaagtaacctacaggtttcttagtggccttacggttagccttatagttctggtccaccagttctttacgccagttagcactatcagtgaacgcgaggacaatcggagcgcctacccaagccttcttacgggtctcataggacttaatggaatcctcaagaatctgacgtgccttagcgtggtcgcagcagcggtgccaaatctcttcctcccatgaggcatcaaactcagcagcactcatcgcttggaagaccagccagtctccgtccatcacgaggatacctttgtcgtcacagccttcgcgtaactcgtagaattgtttaaggtcaagaagcgccattaagtttctcctctagttcagccacgtattcgtcagcctccatcagttgattcttaagactatcgttctcacgttccagagagtcgatgtagccctgcatatcgttccacgcatcacgaggaattgttacagtgtcacgtaccatcagacacaccctcccatacgtttcagaaagcgagtaccagaagcagtgatttcccaagcgccaccgttgcgcccactcgtagtcagacatgagatgtgaccacgggaagcggcctccgctacgaggctcgccttgttccgtacatagttggactggaaagtcttagggcaacttttgattgcttgcagcactttcagatagtcagacatcagaacacctcccgtactgttgcaggagatagcttgaaggagtccttatctgaatactcttcgtgcatatccttgatggcctcgcggaaggctgtacgtactacgaatgtcatcaagccttccataccgtatgtcaggaactggacaatcatttccttctgtttaccattggggacaattgcaccagagcctacctgcttacacaggtgcagcatatctttctctaagattgcctgaacgtcagacgacatcttagcggtaacgtcgaaggaaactttaaatttctttgtcatagccataataatttctcctatagaattagtgacatacggcccaattaggacccatcttaccttcggtatccagaagacaccggaagttccagtggtctccaacccagcgcatagcttcttgtgcggtctcaatgaccacctgagcaatctcttcggtacggcaacctacttggatttcatcgtgtacccacgccatgtacgcaaagtccccatcccagccatgcttcaagcctttctctacgagcatctcttcggtcttgataatccacagcttacaaatcagagcaccagcagattgtagtagagtattaagcgcagcgtgaggactacgaacgtgaaccttacgaccatccagacctttaatccagcggcgtttccacttgactcgctgttcgccagctacccactgagaggactctacaagtgtctgttggatagactcacgtagcgctgcaatcgcaggggtgttctcaaggaatttcttcttgagttccttaccgcgctctttaccagcaccaacaatctgcccaatcttctcatcaccagcaccataaaggaacccatagatgaacgtcttagcgttatcgcgtgtaggcagttcagcagccatctggttcttagtgtggatgtcaccattaagaatctcgtgagcatactcaccgttatcaaagcgagccatgaagtgagccaagcagcgtagctccagaccggatgcgtcgatacctgcctgaacccaaggcttaccagtaacaccgtctaggtgatgttcagcgccaaaagcagcgcggcacttatcaccataaggagaacggacaccgggtatctgtgcgaggttagggaaagcgtgagtagcgcgcccagtaacagcgccgttgggattaacagaaccatgaatcttaccgtcctcagcaacgtaacgaagccacgccttgtctccctcagcagactgtccgattctcttctgaatcatcaagtactctttaatgaggtcaatagcggcttgcttctcagggtcgtctacacgcactccttcgagtacctcatcgtccactacaggcgcacccttatcggtgtacttcgttgggacccatccagcctcttggagtttcttctggatgtggtcacgagacgaagggttaaacactacgtgctctactggggtataaggagcgccagcaacgtactctctggtatccagttcgcaaggctcacggccctctcgctgtgccttgttcttaggcttcttaaagatgccaccaactttaggtgtcttaatgcgagggtatttgggcagcggcttacctgttcgcggatggcagaacatttcggtgccacctttgggctgataccacgagccgaacgtttcggtcagcttacggagcaactcagagcggcgagcagctaactctacgtacaactcttcgattgccttagtgtcaaacgggaacccattacgctcttgcttagcgagcagccatgcagcacgatgttcaacgtcaacggcctcaagggattcagaccagaacgtagtgtatcctacgtccgtaaagtcaatctcaggagggaagtagtgtttgtcagagagtagcttctcaaggagagccttagtgaccacaacgtcctgaacgttataggccatcatctcttcgttgaagttccaccactccattccgtcaacgtattcctcgccttgctcttcaagcatacgcttaaagtcgtccttgtattcacctttcatctcgcctaagcgataaccccacgcctccaaagcgtgagacccaaagcgtttcccaggcaacttaccggaacgcagaagacccatatcggtgtccttgaggttagagtgaatcaagcgtgacaacacaagtgtgtcaatacagttctcacgaggaaggtggaactctcggttcaattgcagctttgccagtttggtcaatgcgggaacgtcatacttgtgaccgttgtggaacacaataagaccgcctcgtgcaacctcggcttccagcgcatccagatacgcaccgaagtcactcggacggtagcttacgtactcagcggtggagtagtcgtagataaccccgcagtggaacttagtgacactctctaagagggcgttagcttcgatgtcagaaacgatcatattgatttctcctgttgattatcgtgacttaacaatctcttcatacgagacaactgtcaagaagcctgtgtgaatcgtactggtcttatcttcaacaattgcacctcgcggattgacataagtgatgaatgacactttcgcatgtttaccattcactgagcgaacgtagccgtagccgccaacaactcccatgtcaaccttaacccagtcgccagccttgatgtgggtcatagtgtccttatcgaacaccctgtggctcagcttgttaacttcttgtttcttccagccagtctgtcgtgtccaagtccagcctaagttcttcaagatgtgaacagcggagcgagtcttagcttcgtggtacttaacgtcctccagtccagcttccagtttagcgatttctgctttgataactttagggtcacgcatgataatatctcctatagtgagtcgaatagtattcatgaaggccaccacttgggcgaccttgagtataccactcttagctatcaaatcttatctaggatagccatagcttcatctacgcgaccagcttcatgaattgctgtcacggcagctttggtaagcgcattgaccagacgcagtgcttgctcatctgtcaacgtcatacgctgagtgtgattcttagaggacttagagtccttccagcggtaaaccatagtcgccttcccgttgcgaacgttaatgtggactcgacggttccactggtcagcggtatcggatagacggatagtttcagctacgttagacataatggtttctcctgtttgattactcaaagaatttggaaagctgttgagcttggcttgctacacgggcagcttcggtaactttagttgatgcactgtcagccagttcgttggagcgaatcgccagagcgcgtgactgtgttgcctctttacgagcctcatcgttcaggcgtttagcttccacgttgtacatacgaaccagcagttggcctaacttcttaatcagtttgaacatgatgtgtctcctttagtgagttgtattaatctcgaaatacgcaataggagcacagacacgaatcgtccggtctgtgtccatatgggttcacatcagaagtcgttgtcgtttgaccagtccgttgcttctgaatgcgtctctccttcatcgccagagtagctagacggttcgagccatccggtttccttgttgtattccatgtagccagcgataccagtatcaccagtaaagcggcacttgagaatacgaacgaggacaaggttaggcatatcgccttgctgattacgctcaagggcaataatagtatcagatagttggcgtaatgcgccagaaccacgtaggtcagtaatagaaacggggcgaccttcctcatgtgctttacctttgtctgggttcttaaggtggcaaataacgaccagcaccacaccagtagacttagcgaaccctttgagcttggtcataaggttgtcaatcatctttcgctcatcagattcaccggaagcggacacgacgattgagatgtggtcaagaatgattacgtcacagcccaagcctgagcgcatgtaggccagcttagctagaagcctgtctgtctcagcctcggcgaatgagtcatataggtggaacgtatcgttaccgaacagttcatcgaaccattggtcgaacttaccgttctcaataatctctctctttagtgagtcggattgtctcagtcggacacggttgtgtagacctataaggtcctcagcggtctcctcaacggactcctcaagcatcgctaagcctaccttcttacccatcgctgtgccccattggagcgcttgttgacggacgaacgttgacttacccataccggaaccggaagtgaccataatgacttcaccgccacgggcacctaaggtcttatcgttaatgccagtgcagccactgaaaagtaaacctacggattcctcggacgataggtgttcacggattcgttcacgtaacgaaagagccgataccacaccgtcaggaatccaagggccagcgttccacacttgctccatgatttctcggtcgtgaccattaaggtggcactcgtttgcatccttacacggaagcacagccacacgaactttaccagcaggtagaacctgtgcggcctcttcaactgctttgcgtcctgcctcatccatatcgaacatcaagataatctgttcgaactggtcaaagtattcgtagttggcagcgcatgtcttcttagcggcagaggcaccgtgacccaacgacactacaggatacttacagtcttgaagttccatcacggtaagcatgtcgatttcaccttctgtgacaacaatcttcttaccgccattccaaaggtgcttcccgaacagggcatcactcttgtggctaccagtggtcttaaagttcttatctttatcgcgaaccttctggctcacaatgttaccgttctggtcccgatagtcagccacttggtacatcacaccgtctactttggcaatccagtagccagccttctgacaggtttccttggagattcctcgcgcagttaacgcagagtaacgtccattggagtccccgaagttccacacgttgtacgacattggtttacctccaccgactatacgtcttcttgatgataacttttccttacgttcgtctgaggccggaactcggtgctcacatacgaagcagtattcatgaccgtcagaatacacagagttaccatcagaagacccacagttctcgcaaggagcatgatacaggaaaatactatcttgttctaattccatatggttattccttaatcaacaatgcgaacaaagggaaaccgttgtggtctccctttagtgagttcaattaattaacctcggtcagatgtgaccagttcgttcttctcccaccaacgcttaaggtcgaacgatgggcaagccttcggtgcaacatcgtgatgcgcacgaagaacagcaccttcgtacttagccagaagtgtgacaagcagtgagcgaagggattgcatttgggccggagtaaagttagcgtcaaacttacctttatcgtcgataccacctacaaggcagacaccaattgagttgtggttgtggcccttagcgtgagagcctacagccatctcatctcgacctgcctctacagtgccatcacgcttgatgataaagtggtagcctacatccaaccagccctgctctttgtgccactggcgaatctcacgtacacccacattctgacttggcttggtagccgagcagtggacaaagattgcatcagtggattcacgttgtttaaactgtacacgagacattacttctttcctcccttcgattgtttcagcttgtcaaatggcacctcctttttgggttctttgagccattccacaggaattaatttgtcagcaaacaggataccgtgcttctcgcaccactcaccgtaactggtcggagaccctttgtacagcttagtgcgtgagcttgagaataccagacggatgtccagttcgggaaactgttcgcgaatcaataagtgtttctttcggtcgtcactctcccataaacctttggtttcaataaagattccgttcggcagcaggaagtctggagtatacacatggttgctcgcagggacaacgtaagggattttccacagttcatagtcgaacttgatacccttaccctctagctgcttagagactttatcttctaggccggaacggaatgtcccgacctttcggattccacgcgcagcgtatgcgccagccacttagaagtctccgtcttcgtctgcttcttcttcggactcattatcgtcgtcttcgtcccagctttcttcgtcgcgtggtttgctcgctttggcagaaccagaggcaacatagccgttctcttcaacttcgtcagcccaatcgtcttcaccgccaccaaaggtagccagttcgaccagcatcacggattccagttgcagcttaacgctggcacctacagcagtgttccacttgtacggaaccagagagtacttgactttcagcttagagccaccaccgataatcggaacgtcttccatcttcttgcccttggagtccaccactaccagattgatgtgtttggtctctttggtcttcttgtcttggaaagacgcgtagcatttgaacttaaaggtagtcgtaccgtcaccgttatcgaagaacggcatatcgccctcatacggtttcagcggtttcttaccacgggctacggctggcgggttggcctcatattcctcaacggcagcagcataagcctcttcgtgacacttcacgatttcatcgaccatacgttgacagcgagggtctttgttaggaatggttaggtcaactttataaacaccacgagggttcccaaagccacgctcttcgttgccgtagtccggcttggagatgtaagcgtaaggttcagcagtacccagcgcagaggtgaaaatcttcttagccataatgttagtctcctttcggtttcatttagtttctcaaagggagtcttctcccaatagtgagtcgtattacttcggtgctacacagggacgcacacgagtaacctcaaagccagccggaacgtattgccattcggctaactctaatgcttcgtctagggtctccgcgtagactggaacctcaaaggaatgctccgaggactctacggtagcccaaaacttcttattgtccacactaagtgaacctgtatttacagttgacatatcagtaacctctcgatagccattggttgtaaagttccatgtagtgaccagcggattcctcatcaccacgttctatgcactcggcccacatcttgtggcaccattcactaggcttttccatattccacctctatggcccaatatattaagcgaagtaacgcgcctgctccagcgaaaattaaccctaagtacagaacatcgttaagagtcatagcacttgtccttatgtttctcatacagttcaccatagaaccccgctttcgccatgtccttctctaagtaagccagttcggacttcttaccagcccgtaggcgatacttaaggatgttcccaaagcagtaccctttaaactgctcacgagtcattgaacgggcaatcacttcgatagcctcaatgtcgtcgaacagcatgtaatgggacggattagtgacaccatcgaccacattgacttgggagttgacaccgcgaattgaacagtctagtgcgtgtccatcacttgtatcgtagtcacgctcgcagttacacacccttccatcgctgtgttcctcggttgaaggctggtcatctgtaggagttacctcaagtttattaaggtgaggtttacgcgggtccatcgctcggatttcacctagagtaatgtgcccatcgtttgtcacaggacactcgccgcaaggtactccagcgcagaacagtccgcaaccagatgtgtctccgctacgaccctcgttattatctatcaactgaatgataatctcttgttcacgttcggtcatattgttagctcctttgttgcaagtgtgtggataacggtcgtctttctctaagcaacccattagaacacctccttgatacgtttgagtaacagacggacgaacgggaagcgggtcactgccacactaagaaccggacgtttcttgtctaatgctttctcaaagtcaccacgagtgataatgatgtggacgctcggtgccaaaggaactgtgtcaccaataagaggtagcttagctcggcgctcgctcgcacatacgattgaacggtcagcacggcgaactgagaaacccttaaggcttttgttgtaatgaagtcgaaacatatagtgtctcctttagtgagtcgtattagaagtattaagcgtgaccatctggcatgttgtcgtcgtcattaaagtggagcgcaaggcatccaacgataacaatcagtagtggcattaagtacatcattgtgtacctcctttagtgagtcgtattaacagttgacgaagcaccacacgcaagcacaggctgccgctaggcaacaagcaccgactactacgagtgctacttgaggatataccgctagaagatatgcaaacgtcaggatagctgcccaagccgcaaggaacttaccgaccttcttaaacatatagtgtctccttatcaacgcagaaaggcccacccgaaggtgagccagtgtgattacattttctcttgagggttgtcctcggtgccacggaacattacgaacgatgggtggcgtagagagccgtcaggagtttcctccatgtagttaatctgacaagcgtgtccgttgtagaagtcacggccttcaatgtttacggtattggtgaactcatccattaaggcgcgagagatgtttgtggcgttaactacacgaccactctcaagaagcacctcaaagccaatcactttgccctcattagccagaccttcggtcccccataccagaccttgaatgataccatcagcctcattctctggcttcattttccaccagccggacttcttgcctcgcttgtagatgctcatcgggtctttcacaataagaccctcgttgccttccgcgcgcttcttctcatacagttgctgtagttccaccatgtcgtagacctcgtaagattcagccgcttgccattctatttcagggaagtattcctgtagcagaggcagcatattcttaacgtgttcctgcatgagtaacgtcatgatgtcacagtcttctccagactctacgatgtgtagcggcagtacagcatacagtttgacgtgaaggtgtccagtgtgcagcttaaagggaactttatctttcttacggactggttcaacgaataactcttcgtggaactcttggttcttagtgtcagtccatttggtacgcagtaggccggaccctgtgttaaaatctacgcccttgaccataagttcaccatccagcataaagccatctttgtagaagcatcggtcatcattcagcaggcgctgccagcgaacatcgaaaccgtttaagtgctccagtgccggaatcgttttagatacacgagagagccagcaaccgttagcggtattgtctacgcagatgttaccacggacaccatcatatttaacgtcagcgataagatatccagcgttgtcaagagctttcttaatggaagactctacgaaagacacagctttgaatgggttagtcttaatgttcatcataatgtttatctcctgttgaggttaaatgactaaggccactcattgagagcgaccttaagcattgtccctatactgagtcgtattacttccagtgcttcaagtctgcgtgtatcttgcggagccactcagtctgggcattgcaccggacatcttcgtctgactgttcgaaacgcttggatgtcagtacgaggccattgcgtaggataatacggagagtctcaccggatacccatcggcgctgtgcgtagttctcatagcgataagtctcagtgaccacactgacatcgtggtcttctttaagtctctctatggcatccttgaacgccattaagtttccactgtataagcgacccatcttattgaccctcccagctacgcttgtgagagcggtcacgcttagttttattcagcttgcggcctttggttgcctcgaagtcatgagcattacggttagaacgtttggtcatcttttcgaagttacgcatacttaaagtcctctcttagtaatctttaatttattatctctgattaacacttaaaggtcttaaagttaaaccttaaggtgtctcctttagtgagtcgtattaaccagaaggtcaatcataaaggccactcttgcgaatgaccttgagtctgtccctctatagtgagtcgtattaattaggcgaacgcaaagtctgacttaaggatgtcttggagattcaagttacctttagccggaagtgctggcatcttctctagttgagactcgtgtagctggtcagcaaactgctcgtagaagtcagccagtacatcacaagactcataagtgtcaaccatagtttcgcgcacagctttgaacaggttggcagcgtctgccggaatggtcccgaaggagtcgtgaatcaacgcaaaggattcgattccgtacttctcgtgtgcccacactacggtcttgcgcaggtggctaccatcttggctgtgtacaaagttaggagcgatgccggactcctgtttgtgtgcatcaatctcgctatccttgttggtgttaatggttggctgtaagcggaactgaccgaggaacatcaggtttaagcgagtctggataggcttcttgtattcctgccacacagggaaaccatcaggagttacccaatgtaccgcgcaacgcttgcgaagaatctctccagtcttcttatctttgacctcagcagccagaagtttagcagcagacttaagccagttcattgcttcaaccgcagcgaccaccgtaacgctcacagattcccaaatcagtttcgccatgtacccagcggcctgattaggttgagtgaacatcagacccttgccggaatcgatagctggctgaatggtatcctcaagtacttgctggcggaagccgaactctttggacccgtaggccagcgtcatgactgaacgcttagtcacactacgtgtaacaccgtaagccaaccattgaccagcaagagctttagtacccagcttgattttctcagagatttcgccagtgttctcatcggtcacggtaattacttcgttgtcggtcccgttgattacgtcagcttgcagaatctcgttaactttcttagcaacaatcccgtagatgtcctgaacggtttcactaggaaggaggttaacagcacgaccacctacctcatcgcggagcattgctgagaagtgctggatacctgagcaagacccatcaaacgccagtggtagcgagcagttatagcttaagccgtggtgctgtaccccagcgtactcaaagcagaacgctaagaagcagaatggtgaatcttgttcggcccaccaagtgttctccagcggagacttagcgcacgctaagatgttctcgtggttgtcctcaatgaacttgatgcgctcagggaatggcaccttatcaactccagcgcagtttgcaccgtgaatcttcaaccagtagaaaccgtccttaccgattggcttacccttagccagcgtcagtagccctttggtcatgtcgttaccttgcgggttgaacattgacacagcgtaaacacgaccgcgccagtccatgttgtaagggaaccagatggccttatggttagcgaacttgttggcttgctcaagcatgaactcaaggctgattcggcgggacttgcgagccttgtccttacggtacacagcggcagcagcacgtttccaagcggtgagagcctcaggattcgtgtcgatgtcttccggtttcatcgggagttcttcacgctcaatcgctgggatatcctcgaccggacaatgcttccacttagtgattacgttggcgaccgctaggactttcttgttgattttccatgcggtgttttgcgcaatgttaatcgccttgtacacctcaggcatgtaaacatcttcatagcgcatcagtgctttcttgctgtgagtacgcaccagagccagagggcggcgaccgttggcccaatagccacctccagtaataccagtccaaggcttaggaggaactacacaaggttggaacattggggaaataccagccagtgcaccagcacgagtggcgatagcctcagcgtattccggtgcgagttcgatagtctcagagtcttggcccacaacgccagcattctgacgatgtaagttaaccattccggttgactcaatgagcatctcaatgcagcgcacacctacgtgaattgagtcctccttgtgccacgaagaccacgcctcgccaccaagtagacccttagagagcatgtcagcctcgacaacctgcataaatgctttcttgtagacatgtcctacgcgcttgttaagctgttcctcaacgcgtttcttgaagtgcttagcttcaaggtcacggatgcgaccaaagcgagcctcgtcctcgatagctcgacctattgcactagctacagcctgaacggttgtattgtctgcactggttagacaagccagagtggttttaatggtgatgtacgctacagcttccggcttgatttcttgcaggaactggaaggccgtcgggcgcttgccgcgcttagctttcacttcctcaaaccaatcgttgatgcgtgcaatcatcttagggagcagggtagtaatcagaggcttagcagcagcattatcagcaacctcaccagctttaagttgacgctcaaacatcttgcggaagcgtgcttcacccatctcgtaagactcatgctcaagggccaactgttcgcgagccaaacgctcaccgtaatggtcagccagagtattgaacgggatagcagcaagttcgatgtcagagaagtcgttcttagcgatgttaatcgtgttcatttagtgcctcttccagttagtaaatcgtatctattcaggccacccgtagatgacctgtaagataagactatcagcccataaacattgcgtcaagtttcttgtcgatgttcagcggtagaccgttagctatagccattctgtcagcgttgaaccaatgggccgctatgcgttcttcaagcgccttaaagtcggcaagctgcatttgtacccatgcgtttgcgtgtctgaccgtaccaatggcatcccttactctgacgtgattgcgccagtcctggcctcttgctatgttcatcagtgcaactttgcgttggcacttttcgcggtgtgctttgcgtgccttacggttgcgacgtttcattctacgcttctctaagcgcccctcgtggcgtactttacgtgccttagcgcggtctattgccatctgtagtgctacttcctcgacttccttaatgagttcctcagggtcaatactgaaagcgccaccgtctttcttgtgcgagaatgacacagggtcagtaatgtacggtacatcgttatcgtcgaacatgatgttaccgctatgcatgtcgaacgaggcgacgccctcaaagaacttgcggattagcttgcaagtctcgacgaactccccatcccatccggtacgcttatcgtatgcagccgatttgtaatcaataatatcgcttgcaatcccagcatatttatcgtgcacctcattatcatacgattcacagtcgttgagtgcatcaagaaccaccgtatagcacccagcgtgacgctgtacatcatagatgttagggataccagcgcgaccctgatacatgcggcagaatgcggtatacgcagcgcctgagtcctctttcttaaagcccaccttaataactcgtttaggcagcagtgggtgactataggcagccgagaagtgaccattaccgagcatcttgaatccagcgtcagccgtgagacacttcaatgtagtccaccaatcttgagcctcaaggtattgatgcagttcggttatctctccatcgcatgtctcgctatttaccatctcgaccagcaagtcgataagcataccttggcgtttgtcaagttcacagattggtaatgctttgattgcatcgattgcgttcgtgatgtcgataatgttcattgtagtgtgtcctatatgttcgttatgagatagcgttcagtgtgttaatgactgcctgttcaagtgctgccagtttcttggctttaaccttttcctttcgccgatgccatgcggcgcgctcctgttccttacggcgttcgaggttatttgctcgccactctctcacaatccgtctatttgctgcataaagtgtcccgttaggcatatagccgcgcttgaaaccttcggtagtttccatcgtgttagtgcctcagatgttgttcaacttacggttggtgcggagttcacgcttaaggcgttcgatacgctgtttcattgcgaagccatcaggtgtacatacagtagacccattgcgtgtatggataggcataacgtagtgtttcagcatttgcgtagtgctcccgtgatgatacaagaaaccaagtaagcaccaacggctacacatatagacttccctaagggtgcacctacaaccagacctagagcggtgagtataccgatagtaatcatgtgcgttgattccttcaagttaagtgataatcatgaaggccactcgctaggagcgaccttgagtctatcactcagcagactccaaggctattgccttgttgttttcgtacagttccttaaggtgttccattgcgagcgaccagttgaagccacagcgcaccatgtcgctatagaacagtacagtttgagcggtcagaccatattgcacgttgccagtagccattactcttcatcctcttcgtagtcttcctcttcctcgacttcctcaaggtactcgttcagcaagtcttctgcatcttcccagaggtcaatcgtgagttgctcatagatacgtgcttgcaggatgcggattacgtccttggtgtccggcataagaccagagtcttcgaactcaaggtcaatgccttcacttgccattacgctgaaaatgtccgcgtagtagtgtgggattgcaccatcagcggcttcatgtacagcatcgtgcaggtcatcagtgtcacggatgtcatcataacggatgttttctttcagcatttcgtaagcgtggtcgaaaacgttgttgtaagtcatgttagacatagccatcttgtgttacctcgtgcagttgttagtgaatatcataaagggcaccttgcgatacccttgagttatccgctagtcatgcactcaagagctatttaccagattgttaaagagcatgtcggtcaggtttcgttagaccctagcgcctttcagtgttgcgcctcactgttccgtcatttcgtggtacatcgtaccgtgtttactgcatgttgtcaaccgttttgtttcaccttatgtgccgtggtgcgcttaagtcacctagaagacaccgtatccgtccggttgacgcttcatatcttactgcatgttacttcatgttgtcaatgcctgtttttcgtatgacttatcaggctgtctacttacccggttgactccggtatctcagggagtggctttaggccgttgtcccgttgacgagatgaatagtaaccctaaggactctttaagtcaatactctttttaataaatctttaaattaatctctttaaggcctctttaagtagtctccttatagtgagtcgtattaaagacgatgattgaagataatctctttataggtaacaacaaggcatctttaggaacagtctttaggatggtctttaggctggtctttgaggataccttaagataggcgttgactcatggtgtctttaggtgtaggctttaggtgtaggctttaggaatgacgttaggaggtgactttaggaggatactttaggaggctgtaacagat

SEQ ID NO: 4 - DNA, 44203 bp, artificial sequence
  BP814
tagcccacccactcacaccctgtcaaacgcccaggaatggccctaaaacggcccgtgtaagccctaagcggttgaactaaggcaatcaccttgtccaatactaaggcgtgccctagcgcttcctaggcgttctccttgtgtaccactaagcgagtacaaggcaagccctaggccacccgtcgagcttcctgcggcagcaggttgaagacggaccagcccagcccaattcccaagccaaccgcagcgcggccccatatgggggaaatccggcgagggcgagggcgagagagctgacacacgcctatatcaaaattttgactttggttaatccttgtacaggactaaggatttactattaagcctataacgaaacctatcaacaaacacaggcaacctactattgcttccataggtatatacataagacctccattgtaaatacactaagagcaaacctaggtctgcccttgtgtacactaagatattaacctgcttacgcagaagatgcagaaggtttcttcaaggcacgacgttgtacatccttggcaatggcataagcttgcttagggtcacggcctgattgaataagctcttctgtgttctggcgtacagcactttgcttaactgatttgattattggcatgcaatcctactactttgcaacccaaccttgagcagatgtaccagattctttaacgtacaatgtactaccaccagacccattgatatcagttgctaaagagcctacaggtgcacctacacctaaagttgtaggattaccatttagtccataaacaatcaccgtactagaaccgactccttggttattctgaggggcttgcgtaccatagcaatcattgccaattagtttaatattggagcaagaagaagtaacacgaataccaaggcttggcttgttagggctttctccatctactccaatattaccttctactaggatgttgttagctcctgtgtctatgctaatgaagtgcctacctgcttcagctgtagacacttccttcatattattagccttaatcactagaccgccaaccttgcagtttacatgaataccatattgccctaatttagagaggatattacgactaagtataccttcgcccgataagccagtaccaatgaatgtagcagcatcagactcacctaaccaaatcccactacctcttccgttttcccaagtattaccttcgatgtgatattttgtcccaaagcgtaaaccgattaaccctaatccaccagaacctgtattaccttttacaattaaattcttacaccaccttgcatctacaccataggatacatcctctgtgaggatcatagtattattagaaatttcaatatggtcatgccaaatgtcactaatatcggtaaaaggccaagatggtgtagcaattagcactggtgttcttacgccatcaaaagtacaatctacaacactaccttgtcgagttccttgcggtttagtttgagaggagacaggtgtaacatgaacacctcttgcattagagtttctaaaggtgcaaccacgtactatccagtttttccagttgaatacacgtacacctgcaaagagcgcaccatctgtagtgcaatttaggattctaatgttgttatcttgaacaccataagctgatgcatgatttcctactagagcaccatacccgccaaatccagaatcaaggtttgggccagcatagcaattctctaccagtaaaccactagactgcacatagcgacctactgtaataagtcctgggtctaactgtatagcctctgagaagttacgactgcctgtattcttaaaccctaggaatttacaatcacgaataactacgttgttccaatctgctaaatctatggcgtggtagtccactacattgttaactgttatgccttcaaacttcaaatcattattactagtagatgcaaatactacaaaaggtgtatctcctttaatgtgaccattgccttcatagacacctccactgactgttacattactagcttgcccttgtgataacctgaatagcgtatctcctgtttcgtagtcacgtacaaatgttacacctttagcaaccttgaagtgtgtattagcaaatatctcaacagtaccactgagtttatattcgccagctttagtgactgatacagtaccaccgcctagcaatctgaccgcattgaatgcagcttgaagggcttgcctgttgtcattagaatatggattaactccaaaatccgcaacatctattgtatccgatagtttatcagatagcaggcgctcaatagcacctgttagtttactcttgtacttcaccaagtaagcacttagtctttgaagcatgtatcctccttttctgaaaggctaccaccatgataacctttaagaaaagttgcgtgaaaagcagtgcttacgcactgcctgttgcttacttaggcagggaagctagtgcttcctgcatacgcttaatagtcctccgcatcaacgcagcctctaatatcagtacttcctcgtaacgaataccgtagcgggaacctgctggtgtaatcagtttacgagagccattggcatcttcctcgtatacatcctcccaactgtcgaagcacaagaagccatagcgatgtgcatctataccgtgacgttcgaaagcctccttagctcgctgagcgatgatgccaaagtgccatctagcggagtctgcacccttctcctcaacacgatccaaatactgaaactgcacaaagtcaacttcagaccaagcatccagtaaggcatctgaaatagtaagaggttctgttttacaccgagcatctgaggtaacagtgaatgctgcttgagtaaaaccgccagaccatgctcggctggcggaacctaatgcgtatgtaccagtactgtctggggtcattgcatcagtacctaactgcaaatagcctgtgctactggtagaaagacgcacgttaccgttggtgagggacactgtccgagaagtaccatcagaagtaaataggcgaacttgagaagaagtacccccacctaaagctaatgatacagcaccatccccaagcattctgtacttatcagcagaagtaagaacgcctgaagggagtgacatggacttaatccgccattcgaacctacctgacatactacctatgtactgccctaaggcaggtgcgtgcactacgttactattattagtgccgtcaatagtagctgcaccgtcaatagtactagcagaactgagaaggtcgtttctcctgccagggtgctttacctctacgaagttacgggtagagccggattcgaaagtaataacacctgtagcactgtagctaggaaatacagacgcatagttgttattagctgtacctataaagcgtgcaattgtagcagtctgcccttgtcctaaagagttagtaccatcacatcctgacataagcacattatttatgacgttatcagaaccctctactgtaacaccatgagcctgcctagcatcagaggttgagtaatctacgagcacatctgatattaagttcgtactacctttgcctgcaacaaccgctgcatacttaggattattagccactaccccattgataaggttattagaaggagctattggccctttagtgccgttgtaagttacatgctggcaatctgcccctataacattactgactatgttgtaactggctgtacctttcaactctactgctccgaactgagggtagttcttagcaatgacgttatctatgagggagttaactgaggagtcagcaagtacgcatccagctgccttattagtagcatagcctgaatagctacctcgaatacctttaatcataagtccatcaggtggcgcatcattagggtatgcgattaaactgaaaccagtacctttaacgtttgagaagttaacgtcacttacagtaacatcacttccaccggcaagagatacctgctgtccctgagttgtatcagtcgccttattactttctaccgtaatattacttaagcgacctgtacgtggattgttaaatactaagtagttacctgtactggaacggtgacttagcaccccactacctctaccgtctaagttacagtaattactattaataccagagctagagaatacaccgtctgagattgtgacagctttctgagagtttaatgaagcagctataacctccgtatcatcagtagtggcgtcacctacagcaccaaacggctttgatgttaaaactctcgcatcaaggtactcatacaaagattgtcctttatgcaagattccttcagtattaggtttggttaatttagccatgctatctcctattactttccaaccctccctatgaagattggctagtaataggccgctcaaaagaacggcgctatcttacctcttctatagtgtccagtaaatcgtaagacactgatacataaagctatgtattaattatatccgcgttctagcgaaagaatatacaaacctaattttgtagcatcaggcttactgaagcagactttatcgtctacctcgtaaactgccgtcagcgtcggcctcagaggtttcaccattgctttctctggtaacgcctgctgacacccggaagtggtcagcgaaccaatcagcaggattgtcactaacatgattcgcttcactttgtgcctccttctcttcttgtttcttcttagcagagacaagcaggccaataagacctgccagcaattctagaaacttattcacaggtgatcacttggcagaccacgtctgtcacagaggattccgtgccagagccaaggtctacaccaagacctacagaaacaagagcaattgccaatgcaactagtgcacctacaaccttcttagatttgaacagctttttcattgcatctccctttccattgagctaataaagttgagtagttctgccaatcttcatagttgccttcctctgaagccttagcaaccatgcgttcacaccatgcaacacaacctaccatcgtgcacacccgtcacgtacatcaatatgagtaaaggagttatacttaccaatcccatatttgccttggtacttatcagtaagatacttatgtacatcagaaggtaagatgcctcgtaccttaatgtcagcagccttaccagtaagatgcatggagttcttagctcctcctacattggagttgtgcttagcacagcgatgcccagaggtgataactacaggtgcaccgaaatgctcacgcacatctgtgaccacctgtagtaattcagcatcaacagtggatgtaccgcagccacaacggcaagcaaactctttacgcttgaagtatttattaagcattattatacccctgctggagtaacagcttcctcttccataccagttacatcccaagggtctgttggttcactgccacgtgcaacagcaatatgcagggttgtgtcacctttctcaagagcaaccattgcacctttctgtttacctgataaatgtttgatgttgatagggtggtctttactcttaaggtctgcttctttaacaacaggcatcgggattgccgttgcaatagtttgtactgcttttactcgaaaagcctgaccagtaacagaacctgtagtaccatatttagccatgtaatcttcctccttatcttaaactgggttaacagttggttccattgttactaacttccactctgaatcttctttgccatcaaccgcgatagcaatcttcaatacaccaccttccacttcaaggcacaccatggcccctttctgtttacctgatttggtggaatcattaataacattgcttttcttactaacttcctcttttttgagtaccggaagcattagttcttcacttacaggttgtacctgctttctcttagacttacctgttaatggttgactactataatcattagccattgtctctctcctattatgtaaatatagtaaggtagtaaggtagtaagtaatagggtgtacaggagtacacccatactaaggcatacctatataacctaggttaacctatattacctattattttctcttattatctgggccttccttctatagtgtccagtaattaataagtccttgaaatccttgcagaaagtgtatttctgcttgccgatttatttcggtagttctgcccgtaaactcgctgctgcatcgctacggaagtgttggtcactcttcgctcagtaccgtaatctccatatagcattgccctgcgtagatgaggtgtattcatagcatggatgtaatcgcgcatctcctgcgctctgaggcgattaatccgtgtaacctcgtcatagtctatctgagaagttaattgccgtatagcgccatacagggcgtctaggcggtcatcgtgccggaggctgttcttctcaatcgttatgttcgacatttgattgaaaagactgtaggacatgcgtagttcaagcggatagtgctgtaccgactcaaagtctgacttcaccatctctgcattgaagataagcctatgggctgccatgagcggctccagcgtctcaatgatacgcaactctttctgtccggtggcgtaatcctcttccagagttacaggccactctcgttcaaaatacggcttaattaccgcctcaaacgcgccatgaccaaagttcttctcaatgaatacctctttaacacccgcctgctttgcggcctgcacaatgcgattcagggacgactctcggtatccgccaggtacaccaaagcactgatacacataaatgaatgtgccgtgcaggaatacgatggctacacccgtctcatctccgttcttaccaccaccagcagggtcaatatacataatcttgcgggagacagcaccccattcgtatgggcgagctacaggtctgtacatgaaatccgtaggcttgttaccatacttaggtgcatcaccaatgatgtttatggaatcattactccacgtaggcatcacagggacttcctctgtaccaaacgaggtgaagattagattgttcaggcgtaatgggtatctgtcagcatccatcatgcgagtgttaagcatgaactgaagctggaacttagcagcaccctgagagatttccttctcaatcaggacttcatcatcatacatttcaggggcacaaggtgcaccactattaccatccaacccgtaccctgagcgaagtgctgggttgtccttcatatcttgaacaatcataggtgcaaggaagtcgccataacattgctcttgctctactgaagggtaacgcgcagtccagatacgaacagagtaaccacgagcaggtaggttgttgtagatagagtttacgttctgaggtgtaccaaggtaaatgatatccccaaactggttgatagattcaaactccttagtcagttcctcaagcaaggcacggcccgctgccgtacgagcattctgcatcgactctacgtcatccgctagaataatatcagcacgagcaccctgcatacctgcttcgattgagtaacatgatacagaaggagacttatcactgccacgtagggtgtaatgaatctcaaacgccttaacggatgcacggtccccagcgtagatatccggcagcataaactcaagaaagtctaagccacggaagattttaactacccaacctgcgatttcctctgctcgcttggcgttttgggacacaaccatgatacgcttatgcggttcatgaataatacggaataccgtatagattgctgatagtgttgtcttagcgataccacgaggcgcttcgatgaggcggtacttgtgtccgtaaaataggaacttcaagatatccgcctgcatacgaatcagatgagggttgcctgcaattaagttatgaataactgtatctgcaaagagaagcaaaccttccgctgtgtaaggaaaggtctgctgtaactcctgtagcatctcccatctggcaagagcctccgcttgtgattctcttgccttagccatcaaccctccttagtgaattgaattatcttaccactggatgcctctcggatagccttgaggcgcttagataacttggactcttcctgctgtgcagcaggtgtggcggtaatgccgttatcaagaacccacttacacatcgcaccaatatccttaccagacactaaatgtaatgctgcatcagggtcttcttctatagtgtccagtattgcctgtgctttcttattgaagattttggtaatagcaccatgcagaatgccaacctcatcctctgtagctgcatgtttattgtgtacgctcacgcttctctctccaaatcttgaacttattataaaaccagtccccaatttgcaacacggtataaatgaatgttgctattaacacccaattatcccaactgataccgaggaagtacccacctgatacgagtgcaggtggcgcaagcttcacaccactatctaccagttcggagttaatcatcccacctccttattctgtgataatcttagcagtcatccggcattctggcactccctctgagaaagtaacaatgtcaccgtctacctgataagcaagtttaggttgtaataatccatcaaggtagacctcaatgtacttaaatgcagagccaatctgtactacttgttggccttctactaagtcaaagttcaactctaactgaatattaggttcagatgtagccacacgactaccaatcaacacatacacctctgtaccagccacaagcggctctgcgaaagtgacagtgttgttgcttatagagtatgcgcctacaatttggtgctgcaataccccattaagaaaaactagtgcatcttgaaattcataaggtggttttacggaaatctcaccaccttgggctatcgtgtaccaaggaacagttctgtgcgcaataccagaagtcataccagccttaaggccagcaatctcaatgtcctgtttggcgttccaatctgtatgcttcttgtcgatggcatcaagctgccccttatttactgcatctcccggatttgtgccatcagccaaatcagtaatcttattgccgccccagcttacattctgtttaatgaagtatccttctggataaaacccatcaagtaactcctgtgtaatctccagtatatgaatgaaagagccatttaaagacttcatatccaaggtaacaccacggtcaaactcagcgtatggatattccttttgtacttcccttcgaatacggaacttcaaacctgcaacaggtgctacatcaaaagtgatttgatgcgtaccagttaattgccagccagatgtaacctcaatccaagtgttaccttgaagagattccactatcacatctgaggcacgaagataacctttatccctgccagcaaatctaaagggataggttacttgcgtaccgttggctatatgttctgtgaaagtataactcatcaatcctccagttcatctaagccataacgcaatgcgttctggattcctattacattagctagaggcactaagcgtaaagccctacgtgccacatctacaccttctgtatcgccctctgcgtatttagttatagaatctgctaaacgatatgcatcttgaccaacacctactagtggtatttggtctatcaaacccttagtctgaaagccagcctcataacgggattgtactaactcagaaggtagaacacctaggccacctaagaaatctccacctagactaaatacagcagttgtactcatcatacccattgcaccaaaggccaaccctttaggcgataacttctcttccagatattcatcttggtcttctcgtccaatagagttcacataggctttcgctgcatacaccatcgaacccaaagcaaagccaaaggctgtcttcttagctagaccaatcttatcgtggcgaatccctcgaccaaattgcttctcaccagatacaagagagaatgacttaagctgtgcaaatgtcttacctagtgctttgttcatccagataccttcatcaccaatgaagttacgttggataattagacctgacttacgacgaatagcattagctaaagtttcacccatggcataaggcattgtatcaaagccaagcaagccagaacctttagagttagcatcatagtgcttctgtaggttagtcatgaactcctgagtaagaccaagttcctccagtttcttctgaggaataatcttcttgccttcaaggtggtcaatgaaagacaaagctatttgcctattggtcattcgctccagagaaccctgtgccatgcggaagagggataggtttgtctgagcacgtcgtatagagttcatggactggtcaaaatgggccatcatacctcgcactgtggttacatcaccaaactcatctggacgcgcacccttagttgttagccagttatcctcaccgatgtaacctaccattcgctcaacctcagctaaattcttatctcgaaagaagccatcgccattacgcaacgccttagaggtgaagcggaattgcttacctaaagccatagtggtggcagcaataccaaactcacccatgaagttagcaagttcacctagctgtgcgaagcccatctgacctaagcgaagcacacctgtgatatcacgaccacgacgcatcatcttagtagatatagcttgtgggtctgcatcaatcgacttgcccataatcaggcgaagaccttctcgcatctgacgaatctcttcatctaatgccaaactagccttgctatccttagccgcgtttcgtgcatttcgctctacaaggtcaattgcattaagtgcagcctgataggtagagaagccttggcgagccaatgcagcgccacctgctgcttccttcatatagttatctgttagctcttccacgttggtattcatgaagtcacgcatacgaatgccattgtattcttgagtaacatctaatcctaaactcattttagctcggttagagatgttatctctggtttctttgttatccagagcttctatcatcttttcaatttcttcatcactgaagcctgccttacgcatgatagcttcatactctgccttagtctgacctgacattgccttttcaaaactaagctttccagttaaggtagcatcagcaacgcgatttacctgtgctcgtgcaatctcatctgctgcttcctttggaatcttacgagcgccattctggtaggcacgagagaaaagttcgatgatgtcttctttatcgtgcatatcgaattgacgtctggctttcatactatcaaagatatcaggcatatatttgttgtcggcttttaccttttcaaatcccgcttcaccagaacgttgacgtaaagccagcgcctctctgtacatagcctgttgtccctcagcagccatgcggatagatttaggtgtagactcatccatgccaatacgcactgcctcccacaccttttcattgtattgctgtacataatgagagttggtatgccctgctactggattgatattattctctttaagccacaaatcaaatccatcattaaaacggttcatatcggcagacttcaggcgatttaagttagtattctgcataagactagcagatgccttctgcatacctagaccttgtggggattcaaacagacgagcaccaaggcctcggatgcttgcatctttagatgagtgcacgacagtaccgagggcagacaaagttccagcccaacggcgaggtgtcatatcaatcgcattaccttctcgttgcaaggttttcagtaggtcttcacccttactggagatatcgaatgcaccctcagttagaacctctgcgcccttaacacgcatcgcaccgatactgtcatcggcaacagcacgaacatagcggtcccctgcgtctgcactgcgcacaacgttcgcagccctgtcatcaccttgctcactgagcttagcggccctaccacgcgctacagcgccaataacgccacccatagccataccggaacctagtgctaccataatgtcatctaaatcacgagtcatgtcaccttggaccaatacggattcaatagcggcattactcacgccagcggcgatagcgccacgcacagcacggcctacgagtccaactttagcggcaccaccggttggaatagaggcaacccatcccacagggtcaagcacagcagcgccaatcgtcgccacagagccaacccagccagcctgagcaatgcgcttattgcgctcaagatcttcatcagcattctgaatacggaagttcaattcatcctcagaacgaacaccctcagtgattgtctgcatcatatccgtaccatatttgaaacgtagtgcttcacgttgctcaggttgtatctcaaagtctggttgaggtgtgaaatcagcagtggcacggtcataccaccgcttgcctccgaatgccaaccactcattctggaaggcagcacctacagcacctaaaatatcagcgtcagctttagcttcaagaacttgctcttgtaactcattacgctggcgtatcgtaggagccgataccggagccgcctcaatagaaaacggctcaggagtagactggacatatccagcccaattagtcttaatgtcttgttccataattcctccatagtgcctatcataaagacctgtctcacatgtgagacaagccttgagttaggtactacaacttaactttacctaccttagaacctttagctaacttggtaggtgcagcctcataaacctgataccaaccatccgcgccaatacgtttatgagtccatgccgagacagaacctgctggcataggtccaccaaacctaacccacatggagccatcttcacgagtctccacttcggtaatcttaggcacaccaccagcagatgccatattgtatgcctcagcgcgtcgcttcagtaggccaggaatacgcttaccttcacttgatgcagtgcccagcatttcgataaaaccctccgtaagcttaccagctttgaatgcagcaagagcacgcggtgagttctggattccacctttacctaaattgtaggttaaatccatcaagccacgttgctgtgcaggatgcatctggtcaaacggaatcttccagtcacgagtaggaggcacatgcttcttagcatcttgctccataagggcgcgagccttgctctctgtaagctgagacatagaccctcgatagggaactagttcatcgccaatcttaatatacccgtttcgcttctcttcttccgttaagaaatgaccgtaaccgatagactcaccgtgagcgtctttatatggagtaaaggttccagttgccttattaaagccaactttatctttattctcatccatagctagcttgtcatagaattgttgcatattacctcgatagttaatctcgaagttagaaggcagattctcaccagaagcaaaagcagaagacatgaggaagttagctagtccaaatttaccaatatctttggcagttggtttagctggcataggctcttgtgtaccaatatctgtacgatacgggtgaacatactcgcctttatctcgttcctctactttcttctgataggcagaatctagtagtgaagtagtatctaaagaggttacagggattactccagaaagagggcgacctgctgcaccagcacgaatcacaaaagttcctttctgttcattgtaatcaatgtatatatcatctttagtttcccactcttgaagctccttcttcaattctggcatctgtgtttctacatacctaccaagcgccagaggtacatcggtagggtttacgcctttcccaactgacataagcatatcagatgcagaagtgtaatcacctttaatgaaatagccaccggaagtctttgcatcctctgattgagtgtagcgtttattgccccaagtaattaaagccttcttgatggaatccatgttacgcataccactagaccacaacatattggccttagctcgtaactcttcttccgcaatagctttacctaagtctgacacttcggttttaccatcaaaccagccagcaccagacacctcatccagtgcctctccaatagctgagttgaacttcttggtttccttctcagtacgagagaatttctgctgtgcttcacgcgcaaaccttgcagcctgcaaaggtgtctctcccatttgtagtgcagtgttgtagttatccatgtagccattcaccgtgtcaccaaagacacctcggctctcttctggcaactgttcccacaactggcgaatagtcatcaactcttgtggttcgcccttggcaaagtgctcaggtgatagcatagattccatggctttgatacgagactcaaaggtatcatccactaagcctttggagttcatgaattgtaggcgctgcacttccactgcaccacgaatagcttcagcctcttgactgtaagggtccaagccacgttgtttgatttgctggtctgcataaagttggctatcttgtttgataacatcaatgtaagccttcttctctttatcagtcttaccttggaagccagtcaggcggtcggagtaaagctcacggcgcatatcctgcattgcacctagctctgcattctgcttagctcgttggcgcatcagtgcctctagttctgggttagagaagacagagttacctgtcagattattaatgtgctgtgctcgttccaacaattcttcatcagttaaatcacctgcaaggtatgattctttaacttcgaaagacatacgagttacatcagctacattattcctagcccaaactgcattaccactagtgatggctgtgataagctgtggattcttagcataaacagaaacacccttatcgtccttcacatacttcagggcttcagccatgctaacatcaccgccttgtgcaagtgaaattgctcgctggactaacttcttgtgcatctgttcaggcagtaatccttgagtaagaccttcgcggattcgttcctgtaaagcatatccagaggcttcagggtcaatattagaatcccaagtagaagccactcgcccgtcaaaggtatcctcacggtctgcttgttcacggtcaagtttatgctgggttcgtgtagcccaaatctgaggctgctgttcttggaagacattagtgaccatacgcatagtatctttgtcaccttgcaactcagggtattgctggaacagcttattctgcatctcattacgagagtcgaccataagctgtgtccactcgtcatccgttccttggaaacgagtagccatgtctttcattcgtgctgcttcatcattagctagcagttgagctttgacaagcatgttagcacgagcgccaccacgagttgcatcctcagaaggcattaatccgttatatgcccgttccatttgaacaaccttatcttcctcaatcttttgattaaggataccagtggttacatcagctacactactggctgctcgaataaggtcttcgataaatcgactaccggaggtagaagctacgccagcctccacacctccaactcgctgaggtgcaaaggtcatgacattaggagaagtggcctgcacttgtggcagaccttgtactgcttgtcgctcaattgccattaaatacctcttgttccagatgaatatgtacgagaatcagttaaagctttacctaaagccatgccggacttactacctgttacataggcagatgccagactcggtataccttgcaccaaggtgctcacggcagaaggtttcttaaactcacgcatctgcatctgaccaccacgttggatggacttaagctggtttgtgaagttaatcttctgattctcatagttatcgataattgtactctggttccttccgccttctgctgctaagtcattcagcatagaagacacagagttaccaccagtaccagtagcaccagcaagcaatgcaacctgtgctctctgctgcagtagtgaagcctgattgcttattgcatccgcatgatactgtttagcagcagagcgttctgcatctgccactgtcttatatgcttcttgtgtagcaattaactgctgccgccattgctcctcctgagctttcttcatagctttggcttcatcacttccaccaaaaagattgcctagaagaccaagaccttgcatacctgcactaagcagtcctgcattagagaagccagcagaagaacctcctaagaaactaccaagggagccaagcaaacctccgccacctgcggcggctgtccctcctgctgctgcggcagtaccaccagcagcggctgctgcaccgctacctgcaaacatactaccaatagaagacataccagccataacggctgaacctatagccattagaccctccttttggttggattgtagctcccttcccactcaatatcacgaagctggaatgtgtggggtgactctacaataatacgataaacaacatccgtgctcttagctctcagtggaaatctgaagacaccttctctcggttcaacatagcctactgtattattgagagcaccacctatacggtttgacgctaatactctacgtactttaccactcttcacattcttaacttctacggagaaatcggggtacatgtcaagattaaggtgaaccaatcctacaactggtacatcaatataggatacacggtcttgattgtctctgataaccacaggtgtaggttcaaactcttgagggtaaatctgaccaacaataaccttcgcttttacatggctgtcatcatacatatcaaaggttgtagacaaagtattgtcactagggttgtacttgaataagaaagagccaccaatatatgaatcccaaccctcgattaagatgcaatctaaaagttctgggttagtaggagtccaaggaagcggttcagacacccattcatcttctgctttaaaatacttgaagactaactctgcttgcctatccattctgatgcggtcattcaaaccgtaggttagtgcatcacccatgtccatcctctccagatatacgccatcccctcgctcaaggagcaggtaaagtaattcaccagaataaaacatacctcgcacctttgtacctataggccacttccatacatgccatgctgattgtacacggtctgttccttgccataaccaatcgtagcagtagattatgttacgatacttatcggtagtgacaagtaacctgttgacattggtgcttgctgccatgttggtaatgttaccttcgatgagtttattcacatgacttgtgattgcttgtgccttcttagtgtcactataagagtctgtatagaactctcgtacaccagagtaagaaccatcattagtggcaaacattaccgattcaccagttactactggcttcactttattgttcacttcaaatgttgtaacaggcttaagcaatgcatttgacttctctaaaggcttatcgcctggcagtatgaattgtgacttatcagagaacaacacggtagcgccatctaaggtcactgcatgttttagctggtagacttcgctagcatctgagaaaatatcaaatgggtcagttgccaatgcagagataaccgtataacgaaagaaatcgaagaagtatgatgtacgagaagcaataaccgcttcacctgctgtaaagcataggcggttctgcaccatgaacattccacctattgtctggggtacttcctcatcaataaaagagggcatagggttagtcaagtcatcccctactttacgatcttcccaatcaccttgtcttatcttgaattgagctatgccgttgatgatacctgtacgttcaataatgtaaggcattgtgcctttatcaaacccaagtaatacatcagcagctattgtttctttccaagacacaaggtttccctctttaggctcagcttgcagccagtaacgagactcaggtttgctgccagtaggccacacttgtactttataaccagcaggagcacgagaagggagtaggtcagtagagctaactttattcttgatagccactaagtccttaccttttgcaccatcggtggttgttattgtaaagctagcaccatcccgtctctcgataaatatactagtaccgtctctttgtatttcatagtcactcacaccgctccattgctgcaacttagagtacaattcagaagtgatacgttcagttcgaatttgttcaacatggtctgcacttccaccatccggtgttttaaaactagcagcgttggccccattaattacaatggaataagatgtaccgtattgaccatatgcacaaaacacaatggctttatctccaactttaggtgacttcctattactaactttaaccactttcctacggttaagcataaaagtaacatcagctatagtcatgaattgcacatcttccctagggttaacaacttcagaaaggtaggcaataggtgcatcttgagagatgacattgcacttgcgtccatgcttatcaaatatctctggcacttgccctttctttaaggtgaagaaatactcttcatctccctcacccctgcgataatgatgagtagccatatcatcagtacctgcatcaagtacctttgcaatatgagttgtacccattcgggattgagtgccattcactacatcaggtatcatattaaccatagctgtgcactgaccgtccaagcgcaccgctggcggttgctggctaatcccttggatttgtctgcctaatgaaccttgtacttccattaacgatcctcccaaggatggagtgcccaactatcataaggtgaatgagagtaagcaggtacattctgagagccaccagccatgataccaaactgacgctgagtggggttatgtaccagcatgtttaatcgcttctgtgacatttgctcagattgtacatccataagaagctgagtggctatctgctgcgcagtggctagcttagtctgatctgcatccttagacacaataaactctacagcagcttgataggcaatagcctgcattacacttgtaggtagatgctcgtagggtagtaaggtgagtaaggtaagacgaatcatgccattagcattaacatgcttgcgcatatcaaaggtgtgactccatgtggagtaaagcttacctgcacgcatagtcataggcactttcttctcacccaatgcgtagcactgcaatacagctaggcagttattaggcaagttaatctcaccattagtatctggtgcaagctgccagttaggctcacggttaaaccaccaaccacctcctttgttgtattggaaacgttgggagacgatatcaatcattttgctagcatcttcagcatcaaggtcgcctgagtcgagagaatccacaccctcacgaccaatggctcgcatacaaaggttaacagcctccagcttactatcaatcacttgaaaggctacatctgagacagtatagccagtgtaactttgttgtttaataacaggcatgaatcctcctaacaaaaagaaccctacctacgcaaggtagatagggcataggtattactcagcaggtttcattgcagtcggcttgatgtcatttgccattacagcacgtaccgccgctacaaggtcttccgcttggatacctgctggggcagcagagaatgcagccgcagcaccttcggttttgacatatacagccttacgctgtgcacgagccagtacggttgcgtgatcatcaccagaaccttcagcagtaccagtagttgcattacgtttagtggtaactacagacactgcttcccaacggtcagggattgcaccctcagccatgaaggtgtcaatgtaataagtcttctctttcttctcatagaagatgtcaccagtcacttcaatggtacgacccaccagcagtgcgtcggcagtgaacagaacagcaactgcaccattcatctctgcgatagggtcataacgatagccgttatcttcattagacaacaggtggtgagcctgattctgagcgaaggtagggaatcggttagacgggatcacagggcagttataagaagagagaacgaagccattaatggttgcaccagactggctgatagtgtaagtcttatctacaattcggtctgcatcacgcagagcattgaagaacttccacggcatcatgatagctacatcagagatgtccacttcctgctcaagctgttgctccagagcatactctaccgcagccataacatactgagggttagccagtgcttcactctcagttacgttaacgttgatagagaagccatgccctttaacacgcggcttgttacgtttggccttggtgttagcaataccgcctaacagcatctgctgaattgccatctggtcttccagacgtttcagttgcttggcttggttcatagccagttttggtttcaggctatcgatgtcaccttgtacatcgtggatgtgagccacagtgttacgagcaatgacagtggtatcaattaccaactggtttttatccgcctgagtaggggtggcattaggagactgacccggtgctagcacctgcaactcagtttcgcccaaatatttgttgctcactgtgttagtgccagtaacagtttgtacatcaaagtaggacagaatgttctcacctttcaggtactgctcattgaccttaccattaaacttctcaatgagaaggctgtcaacctcaccggatgcagatacagcaacgttagtcagagtattcggtgtagacatgtattataatctccttataaatcaaattgataactagggagaacttttctcccttctatagtgtccagtaaatactgaattagataccgcgagccatgccagcacggcgacgggcgtccagtttagcctgagcttctgccatagctttacggtcattgccgtacttctggctaagagttgcgattgcttgaacgtactgatctcgcgtcagtgggccattctcttcattagccttagcaggtgctgatggctcaatcagggatggcctatcatcaccctgtgcagccttacggcggctctccagttcacgcacagcgtactgctggaggtactggttgccagactccatcacagcattgaatgccattagttcgtcatcagacagcgcttcaagtgcccactcctcaagacgggaccaaccttcttcgccaccaatttccttagaaacatcagagaagcgttgggtgttagctgcttccaactctttagctgcgttggcttctttcaggaagaaggcttcattttgagcctttagacctgacaggtaagcatctaccgcaaacttgccaaaagcatcatacaatttctgcttggttgcatctgacagttcaaacttgccacctttggaatagagttccttggcaacctgcttggcatcaatgcctttctctttaaggctgtcagttacatcctgtgggatgtctactgttacttcatgttctccgaagaagtattgcacttcctcagtgtcggtcgcggtatcatctggcttaggttcaccattctctccgccattgtctcctttttctgaaggctgtccagaagcttctcctccggtgtcttcagtaggctgtgcaccagcattgtcatcttgtacagcagtgccagcgtcagcaggagcatcagtagtagcagcatcagttgttacctccttggtttctaccggaccctcttcagcagtagggtgagtggttgacggttcagtaaatgagaaagacattacgcctccttaagttcttgttgaattacacccggcacggccttagccacaccttcttcaagcatctgtgcttgctgtgcttgcatctgtgcttcctgttcttgtgccatctcttcagctgatttaaggaacggcagttcagcagagatttgaccacgcacccaatccatatagtcaggccatttcacagcagctaggacaggctcaggccattgtaatggcagtgacatatactgagcaaagttagccagtttatccaactcagccatgcgtcctaaagcttcaatacctgtgataatcacagggtccactaagtcactagtgaaggactcccctgcctccagcagaccccacatcgctactggcgattgcatagtagtagcaaagagggagtatacaccacccatgttctgctcaatctctaacgcatctcgctggatttctacagcagtaacacgttcggcgtcacggcgtgtcattgtctccatcatgaagacaacaccgatacggcgagtgtatacctctagaaccgcgctaataggtgtgaggtctgcgtacttacctaactgtacaatatggatgtcttcttctacaccagtgacaacctcaccagtgccagagttaacaaagtggtcaacatcagtttgagcacccggacgaatcaggtacttgatatctgccatcagcgcagcaccacgggcaaccgcttcagataagaattggataacgaataaatcaccggagtaatcctctgcaagagggcgaccccaatcctcaccatagcttcgcttccaagttaatgggatgaaaggtagcttttctgatttgattttactcaccttacccacagggatatcatcagcagattgcttgagttcccaaaatccatcaccaagatacttagcatgtgtgtacagcttaacgctgtcatcctccttgcacttcttacctttcaggccaacctctactacagcacgtgtagctgggtcaaaggtgcgtaaggctttctcttgcagtaagataatgtctaacaggtcgccattggtatcacggttaactacatagtgatgcattgggatagcactgattgcacctttgctcggcttgtatagcatacagctaccagcaacaataagatgcttgaatgcttccactacagcaggccggaattgacgttgctctaactctttcattgcccgtgtttccacttgagcgaagatggtagctagctctgtcttcttcaggccacgctgattaagaaccttctcaccttgtgcagttaagtctacacggaagaaggaacgctgtgcaggaaatagtacttgcgctagcttgttggctagatgattagttgcctgagcacctacaccttgccatccattctgcgaagtctcgttatcacctttgtcattcatcagatagggcaaggttaatttggagtaatgcttcgccctatcaaggaaagagctacgtttagtggagaacttctcccatagcttaggtatcttagaccgcttacctccatactccaaatctgtgctctgtttcatattacaccttcaagctagaagctaccggacggacaaggccgcgcttaccttttgcagatgcagtcgcatcatcaccacctgcaccaatttgaatatcttcagcttcagtctcaggcttacgctcaagctgctgtgctgggactttggcttcaatacgtggtgcatcttgagcaagaccgatagccttaaatgctttctttacaacacccatgttatctccttagaacttcaggttgtacacagtgccaaacggttcaaagccaagtcgcttatacatacgtccgacacgttcttcattaataccagaggcgatagacaggcgaacctcagagcattcattttcattagcccattgtttaagagccttgataagacgcatacctagtagtgtccctcgcttctctggtataatgtaaaagagaatgtcagaggcaacccttacaggtgtccaaggggctaactcgtgatagccagcccacaggaaccctacaatcttcccttcatctacagccacccataggaataaatcttctctactaagagatgcacaaaggttatgtgcactttgttctgcattccatgaggctgagtgatgggccactaccttgacttcctcttccacatatttattcccaaggtttataatctcaggaatatctaggaaggaagctggacgtatcattgaaccaccagttgtgctctgacacaatccatgatgtaacgcttcacttcatcaacgattaactcttcatgagtcttagtcaccttcggagaagaaggcttgagaatcatctcaagcatctccattccttcaaatgaaatcgtcggtttcttcttcgtctgtaccatataattcgtcaaccttctcttggatagcttctacagaaagaccaagttcttctgcatcagcaagtaaagtatatggcacttccatgccacaggataaagtttcaaagatagcttctgctacctcaactgcacgagttgccttcatgctatcaaaagaaatctggttcatctttgtcatgtcttaattctcccgctttgggcagacgaatgttgcccttgcttgaatcctgaagacctttgacttcaaagattttaccaatgacattcaatcgtccaccatgtttaatgtcgtggaacatctgttctgcatctgcatgagtccaccctttacctaacatagctttgattgtcttgcctcctttccatttgaaaatgaggttagctaccttacctttgtatttgcctttaccttcttcaaagccaatacaagtaaggtcataagttaccttacggacttctttagtctgacgataacctttatgtcctgcttcataatcacagtccagtttaaacacagcaccctctcggcctgcgtctatctgctcttgcgcaaacgcttcaacttctcgctcattatggcaaggagtaataggaaggatagcgttgtacccgctaagatgagcgccgatgcggcgatgtaaagcatcgtaacgtttgagataagaaacatcagtgaatccatcatggaatgccttaatagttaacatatcgaagaagtcgatatacaggttgtctttaatctgctggcctatgaaatcaagtggctcagtgcgattggggttcacaaccccagagattgcctcaaggtagatatcaatggccatagactgaagctcaccaagataaatgccaaccggaaaggtagcaaatgcttgttcgaggccttcagtgtttgccaatttcttaccagtgcgaccaaaaatgccaacgacaccatcagtgcgaacaacaacagcagaaaagataccatctcgtttcacctgtgcataacatggaaaagttaatttcttctcaggaacttcaccgcgatgcttcaccagcatgaatgggtgattgcggtggtcttctggaagacctaggaactcaaagatattcatatcaaatatcctcatcaatacattcgtgacgatgcttctggaataactctttgtagtaatctgctttcttcaggtcttcttcagtgttgaacttcttacctgcacgtagacggtacttcaaagcattacccatgcaatagccagcgaattgcttctcggtcatactgcgggcaatgatagtgattgcctctacgccatcaaagaactcgtagtgcttaggcttagttaccatattgttgtctaacttatcagatgcaagtttgaattttttggaatcccaacctgtacccctcacctcacgaaagcacaagttaatgccatcaatatcatctatggttacagggccatcagggtcaataccagcttctttgcagtattgattccaaggaatcgaatctttttcattacgaaataccttgtctccaactttaaaagatgttttctcttgaccacaagtacagtaatcataacgcttatgacacttcttacattcatagtgtgacatattgaatcctccattcactatacaatcaagggctagtgcaatatcatttggatacgccagccgataaagtcttacctagccctttgttctatagtgtcaactaaatcttgccaatccaacggttgtcgctattggtttgcatcgggacaatatgaggcacaccttccaaaataaccacacaacctaatgctggcttgtatttagactcacgcccataggcaaatgcacgggatgactcatcaattaagcagccaccctgcacagcccaatactgttcatgtgtattacgtgcgtactccacagacatcttaccatgcaagtgaccgcacactaagttcatgcgctcatgcgctgcatctgctagaacagagccagcaggttgatgcttgaacgccacctgttcaccattaggtagctcaagaacatgagtatgctgccagtcccactggtcgccacctccctgcgggaagaagacttcacggtaggtgcgcaggtattgcacagggatgcctttggcgcttgccttacggaagtgcatagagccgtggttagagtgacacaggcgcatcacagggaacatcttgtgcaatttgtgcatgaagatacgagccttctctaactccatgccagcactatccagatttgggtccgaatcgtggaatgacagggcatgtttgtctgcctcatctcctaggtgtaccactgtgtctggacggtaacgtgctgccacggctgcaaggaactctagggtatctgggtgctcataaggtgcatgagtatcagggatcaccagtacacttcgatgaggcgagtcaggcaatggcacaatagccaaatcctcgtagcggtcaggagtcctgagcttacgctcttctttgatacgcttatcttcttgcagaagggtctggtaataatcaccattcttcttggtcttcttgaattgaccatgccagtatcgagccaactggcgggtaatcttcttacccacagggtgacacgataatacacgtgccatctcattgtaattaacattacctttctcgtcggtagcttgctcgattgcatcaagtacctcggagtctttgtacaagctgcgaagcttacccaactttaacctccttctttcttgcataagcaaggcgtgccttacggttcttagcctcgcgcttctctgcctccgtttgatgtttgtgatataacttatctgtctgaggcgtactatgtaacttccagtattcatatagtcgctctaaccattgaagctggaagtaacggttgttacccgccttaccgtaaccagagataacacccttaatctttccttctgcaccattgcagcctcggcatacaacagcacggcagaatcctgtctcatggtcatggtcaagtacacggtttataggggtaacagccttgagactgccgccacatagggggcacttccatccttgcttctctagcaattccctcttataagctgctacctcagatgattttaatttgctaaccattccgcatcatctccccacaagattgggttcttatcggctcgccatatatcacctttgaatcttgccatgtgagctaggcgaccacattcgagcatcaggtcaaaggccttgccgatacgataaccacctcggtaattcttaatcttaacttgtccatgtccgaacttagccttgtaagcaccaagcactgccatgtacaactctttctctgtcttacaatctttgagaagatcataggcgtatttagcaccacgtccaggtatgccagcatagttatcaatatcatcaccgataatcatctgtgcataatgaaacatgaggccagcacctttaaggtctttaacctgaccattagccttacggcgtaactcaagccaacccataggctctacccatttcttctcttgacccggctgaagatgccaaccgggaacaatcatcaaatccttatctaaggaaacgatgcaagtatcagagaatgctttatgctctggactaccgatagggaactcgttacctgtatcttgctggaagcggcggtggctgtcccattgtgcaatgctcatgaggtcatcagcctcttctccatctgccaatattgcaccatgaacctctaagagatgctctcgcaattcatagaagaacggaggcttctcggtcttacgttgacctttataaggcttggtgaaggctaggcgaactcggaagttagcttctgatttcgtcatgaataacttagcagcatcacactctgctgcatacacccaagagttaagcaaggagttcacacggtcacacgcttgcttacactcaggggtatctttgattgatgggacttgtcctgacttaacacgagttgtagctcgtacataagtcatgtcactgattgtatacccgacgatgtaaggtaacatatcagcatctattaaagcgattcgattaccttcagttggccacaagatgagattattgtcttccgatactgtagctccgaagtcgaagtttggtcgcatgtaggccactcctctaatacactgagtagcaccttgtctgctatggcctgatatgtataaccccaataacctaaatcaaacaattcaggaagggtgaatgttttagtgtgaaacacttctccatccagcaggatgattactttaaagtaatcttgcattaactttaagtcacgaccatacacatagtctgctactaaacgagatttaatagtcggcataattcattctccaataactattacgcaaaagaccctgcctacactaaggcagacagggcatcaattaaaactcttcttcttcgcttaccggagcatctaccggtgcagctacttcttctgcttcctgagcttcagcttcttcagcagacttaacttctttcaccggcttaccagcagcaatccaatccagatattcagctacgatattagccttaccaatctgagctttgtcagcctgctcagggaagcaagcgcgagcgaactccagaccagcagcgaagttacccatgctgtcaatcttagcctgagcttcttcacgggtatcgtaagccttagtaccagctaccagttgatcagcttcatcgacgataatgaaagactcaacggataccagagcagcacctttaacaacacggtttacgatagtttcaatcttgaacatattaaattctcctttgttagttgtggcattatcgccgattaaaattcttctcttctatagtgtccagtaaataccggacaccgatttgtctcacatgtgagactttataaaactgtgttcacctgagcaatgtcatgcgccggaagcgatacgccgtggcgttttcccgtagctgggtcgctgtagttcaccacgtgctgtccatcgcgccagatgtagtgcagatcagaataaacctccccctcggagaaggagtggaaagtattgccgccaagcgtggtgattcctttcttgcaatgcagagttacgatttgtactttcatcagttctccttaatattctgcgtcctcatccatctccggtgcaggcgtatcttctgcttcaggtacttcctgcggaacagactcaccagtgtccagagatttacgattagctggagtggcatcatcatcatctttcttcttggccttcttccactctgggtcttcttcacgagcagctttaatgattgcttctacatgagagccagcaacagacaggttcttaccacgaggcgtttcattcaggaagtattggcgtaccaagttagcaggaatgtcatcaaggatttctttggtcagcttgtcgaaagtgatgtgacctgtcatagacagaccctcttcttcaacctgagcaatgacaagtttcttaagcttgtcaggcataccaccgaatcctttccagttaacatacttgaatgaaccatcgtcattcttgtcaccagagccaaccatagttgcagtcaggcattccccgataaaatcatcgaagccaccaagcaattcttttgggtcaactgcattcaggaacttagtcagtgttgccttatcaccagacttcagaggaacagccatccattgttccatgcgagaatcatcttcgttcttgtcatcgtcgcccatcaggacaatcttaactagaacaaagtttgctggcttcttaacttcagtggtattacctttcttaaagatgtcttggaaggaaccaacatgaatgatgccagagattactgcttcatgatcacctacttctgggttcttaaagactttaccttcagatttagatacggaagcaccaaaatcaaaatcaccacgtgccatttatttagtctcctattgtcagttagctttgtactgagcacaagcatgtactcactagaaagcccgatacggtatcgggttgtgcaagatgcacaatggttcaacatcaacaacactttacaatcataggccgaactaagccgacctattgttctatagtgtccagtaattacttatggattaccttaatgcgtgcaatagtatctaaagggtagatgtaactgacacactcaccatcttcgacttcttgcacatttacaatagccatagtgtcacaaagtgataggctcaattggtgacaagtttcaccttgagtgaactccggcccacgataggcatctgcttgttctaccgtagtgattgcggtgtcttcctctttagccagacgagtgtgacctgcaactttacgctgctctagatcacgaaaaaaaaaaaaaaaatgatacctacatgtttagcttgaattacttcttccatcataattccttatttggtcaggttgtccagttcgatttcaagcataacaatctctttcttcagactgtcagatgcagattggtgtaccagagcaatggatgccttgttctcttcaaattcagctttcatgctgtcacgctcttgctggtgacgtgccatcatatcttcaacctctttgacttggcgtgcattaaggtcatcacgagatgcatagtagcggttatggcagtcaatcatttgagaactacgatgttcttcaactttaacttgctctgcctgtactgcctcgatgcgagactcaatagctttgatagccttggacttgaacttattagccagaccacgaaagtattgagctacaaataccagagtagttaccatagacatgtttatatctcctatatttacttaattacctatactaccttataaacctagattgtctaggctttccttctatagtgtccagtaaatcaatgtactactgtgacattacctacaacttgcttggcataaggctggatagctttaatattattaataatatgatgtaagaattgttcctctgttaaatgcttacaagtagatttagcgaaactaaagtgtcttctaatcatcataccttcattggaacgcacctctattactccagagatatgacctcgctcccaagccttaacctcaatacctatcttacggtctttagttaactgataagcagtatatttaatcataatatttccttagttaagttattcataaaggccactcgtaagtgaccttgagtataactcagtcgtagttaccatcacaatccgggtcaatgccagagaaggcccagagtactaccataaataatatgataccaagaataataaaagcagtttgcattagtcgtaaccctcttcttcatcaggtatatctagtctcatactcccataacaagcaagcataaggagtgtaagaaagaaagtgaagaataggcaaacaatgtcaagcctatccatcagtgtgtttccttccagcttgcgccaatcttatattcgcctgccatcgggcaacgcatcttcagatactgctctgcccaagtcatggcgtcggcaatgatatgacctgcacggtgataacggcgctggcaatgcaatacaccagcatcagcatcaacactgacgaggtttgcagcagaccacatacgtccttcagaatccacatgaacacgtttctcctctgcatcgaacactgctttcacggcagccttctctgtttcgaacccatctaaggtgaaaggtaggtcgtagttgagatacaagacctcctcttcaggaacttccatctggatttcatcatgcacgttagccacaccacaaggatttcccatagcatccaaggctacaccttccttgcgcattactgcaaatgcctttactaatgcatatttcatacacaaagagccagtcatctggagtaatacgttaagcatcgtgtgctctttaagttcaccaccagacatgcggatgcgaccccaatgcccatcaggtgcttgcaggtagccaaacttgttaccttgtgcgataacattctcacgaagacgtgcaagagacggcagttcaatctcgaatcttgccacaacttccttcatttcttcctcagtaacaccacatactgctgcaaggttggctataccagagccatagaggaaggcgtatataaatgtcttcgccatatcacgcttaggaagaccagccttcatctggttatgcgtatgaatatcaccgtgcagtacaatctcttggtactcagggtcattcatgaagtgagacaggacacgcagttcaagacctgcaccgtcacaaccaaggattagcttgcctttccctgctatgaataaatcacgtaaaggatacaagccacgggcaggaatattaaccacgttacgatgacgcatacggaacgtagaagtgccaatactaatagcaacagctggaacacgccactctccgtcatctttgtcagacgtaggccaacatccgtacctctcgtagtattgctgcgcattgattcctagctccttgttgaatgctacaggtacaaggccgcgacactttcgtacaccagcctgcgagggccacgttcccttctcgttgaaggcttcaacgtcaccacggttgagtatctgaccacgacgggatacgagtatgtaccatgcagcgatacccaagcaccaatcagggactgttttaccttcacgtgcggctctttcttgccataaagtaagggacttttcatttatcttaccactccaaggtttgggtaacactccgtgctcatcgagatgagcttgctcggtatcgttaaattcaacacctttccatccataatcatagagcacttgcttaactgtatccctgttacccaagggaatctcttcgaaagtaacaggcgagtaagcgccaatccacttgatgcttggcgtgtcattacggtttcctctaaggtgagggaagtctttcttgacactagccgaccaatcaccagacttagtagtgacactccatactgtcttgcgatctcctcgtctctcggcatgaagaaagtgtgaggggtcaaggacagtagatatattgttgctagctccatactcatttgcgcgttggcatacttcattcttttcttccggtttaaaaggtttagacttgatacgcataggcatgtgagggcggaacgctgcgactgtctcgtcaatcttagcgtccaattcttcgcatcgggccaaagccttgtcgatgtccagacggaacccgcgctcggcctgacggctcatctccagcgccacaatggactccatgtggaaggctgtctcaatacctaggccagtacgtttattcacgccacggcgtttgtgctccgtccactctccgttgtaaagccataggaaaaggtcacgaccaattgccacgtcttcacgtacacggtgaaccatgtggtcagttagtttagaccagtcctcattctctggtttatagcggcctatacggatgccgtgcgcctcaattgagtgaggggcgacgttacccatgcctttggcatatgcttgcggaggaaggcgtctatctgggtttagcagacgactcatcaccagcgtatctacaacacggataggacacaggtcagcacggagtctgcccttaccgcgcttctcggtatagttaaagcctttccaaatatcagggaatgctttctcaaagagaagaccgtcataccctaggaagttctgcgacacaatagcctcacagtgcttcaggaagttaacaccgtcaaccaaggttccatcttgatgaccttcccattccttcaggcgttctcttgcttcagggtcacgcatctcatacgggtcaaagaagagaaactcctcggtagtaagcaaatccatgcagcaaatgatatgcacatcttcacggtgtccatatcggatagcgtcaaggagtcctttagcttccgcatccatcacgaggatacgaccttctgcctccttcttccaatcaatagtcttcatacattgcctctgtttcgtagtaatcatctgaacgttcgggttttggattcattgagtcataatagtcccaatcagaatcataatcacgtggcataatgcacctccaatcaatatgatgaaaggctgtctcacgtgtgagacaacccttgacttatcgactgcgaatcttacgtttcacttcactttccttgataacctgttcacgcgtcaggctattcttctttgcttcagccatagttaactgtgcaaacaggaaggcttggttagtaatcttggcttgcaggtcttcatgaccatcgaacattttaagactatgtttattctgcatgtttcaccatgaagctgccaatgactttaaaatcctcacggaattgcctttcattccaatgaccaaaaagttccatttggaaacttgcactactactagcacctattaatgccaatccttttgaagtactatagggcttaacaccatttggtgctacaactgcatagcatttatgaggtccacgcatataaattaatactttagtcatgattaactccttagatattcacgtaggtttcttcagtaacaatagggaggtacagtaactcttcatcattcaagatgtgaagacctttcaacccttgcttacgaataataccttctatagtgtcggcaaaatgcttattaattacacgtcgttgcgtaccgtgttctgtgattgcatggtcaacatccctgattcgtacaggtacatttggatgcatcatggcttcgccaatctttaccatagcttgtcctgtggatttaccaagagcacgagtgttaaactgcgtaacacctagtgcagtgccacattgcttaatcatttcactttgagtcttaccagtgattacattgcggcgctctttcttaattgtggtgcgtcgtccatttgaacgctcaaactgtaatgtcttccaagctgcttctgcaagggtcttgtgaccagcgccatacatagaaccataacgttgagcaaaggtaaaggctttaactgcctgacgtgcacacttatcgcaaacctcatcatgtatgcacttacattgattgtttatctctacaatcttttcaagatatttatgtgctgttttcttgtggtaagaagccttaataccaccctcatattctacatgatacatgttctcacttacacgagccactacaccacggcaacgataacgacgtgaggcttcattgatgttacgaacataatcacctacattcaatactaatttatacataatcaatctccagttatttaatgtacttaataagagcctgtctcacatgtgagacaagccctgataaatacactagataaggcgtgttacaataaagaacattgacataagaaaaccagatgcaacgataagtttcacagctttcttgaatccatatcgtgcagcataatctgcgatcacaagcatgaataggatctcaataccgatattcaatactggtttaataatttccattaaaactcctgttcatcgtcaaaggttgtctcttctatagtgtccggtaaatccggcacttcttgttgccttgcttcacctgtatcaaatgacttagtacgggcttgtggttccattaaacgtccggtttgaatgtcacccttaagcatgaccttggttccagtgtagataccttggtcgcggtctttgacacatgagatatacgtggtagtcctttcatcaagcgtttcagctcttgtattacgctcaatccccaaggcgtaagatgcccagaatccgatagcgcccgagcctcggaagtcagaaaggataacctcgccaccttcttcgtgttgggtacggtttgccggaggacgtgtaaggtgtgatacaaggaatatagtaaccgggtgtcggtctttgatagtaccaatccgcttgacgcattcatcaagtgcaccaaccttcccaccaaaagcacgctcatctaatttaatccccgttaagttatcaatgatgatattagaaatacccatagcctcaaactctaggcaagtttgctctaccttttccatcgaatagtcaccctctaggtcagctacaaacagcttacctgtatcagctacataatcaatggcggcgttagcttcttcctcggtgtagtcgaacacctcacggtatccatcttctttcgggtcgttggttggcggtaactcaatacgcttatcaatccacttgccgataaaagcacgggacaccttgaccatcgggtcttctgtagaaatgatacctacagattcaccgtgttcttcaatgaggtgcttaactacttcacgaaggaactcagtcttacctacaccagaccctgcacctacaatgataagctggttcttacgaatacctagcgttaccttgttcagcttaggccaaggccatgatagtccttgctctggacgtgcagccttgagcttatccctttgagatgcaatagatttaatctggctaccaaagacttcatcagatgacttggcattaaaccatgcatctacaaattctttagccttgccagccatcaatgccttgttagcatctttgcaaccagaggggtattcaaggatataggatttgccaggaaacaggcgagccgcttgctgattctgcttctgccccacctcatctccatcaaaaccccatataatcttcttgaattgggcgatatgctcacggttctgcactatctcttcaaggcaagactcacctttattgacagaccatacatggtaaggctggccttcccacttagtacccttggcagaatcaaggagcatctgctgtgctgctagtgcatccagttcgccgcccacaataagcaagcaatcctttcgtcttcccttgtctaacacgtgagacaaagtgttcataccgaaaaggtcttgcataccaaagagtttacctaggtgtccgaacttaaaatccttcggcaacgtccggcattttgctccaacaagcacacccttttcatatcgtggataatagtgacggttgactcttccatcttcatcgtgtccaacgcgcacatcgtacattgctgcgatgtcacctcgaatgtgacgggatacaaggttcttacgcttgagcgtgaggaaccattcaacatcaagtttccactctgcttcttggtctgccctttcttgctcattcataacctcccaacggtctttcatacgcataccaccaagtgcgatggcgcgtagcttagggtcgcttatcttcccttccttctccatttctttgaattgagaaggtgtatatttaatattgccagtaataggtaactcggttatctcgatgccaccttccggcttgtggtaataaggtttaccgttatcatggaagtgaccacggttacagtatcctgccccgtcgtcaaagatcattaaatgattgccagtaatatcatgtccattcttttgacaggcaggacacggtacattctgaataatagccataacttagaactcccacgcagcgcgtttagatgcacggtcacggaccggtttattcagcttcttgcctttcttctgcccttcttccatgtcaaaacggttagctttacgggccatcttttcgaagttgcgcatggttaaatctccaaagtgagttaatcttatctatactgtccggtaaatacgaagtctcacatgtgagacaacttaggtctgcccttcctctaagtagtaataagaggaaggaagaaggtaataggtattcctaggtaaacctatataacctttaatacctattacttccttttatatcctttatcttccctttctttccgtctccgacggttatcctatagtgtccggtaaataagtctcacgtgtgagacacggttatgttaattaaatgttacaggtaataggtaaaagaaaaggccattccctaaggaatggcctattaatattatgcgaagcaatagtcagatactaagatttcgttaaggtcaaactctccttgctctggcacttggattccggtgtctactaaccagcgttcttcatgctcatctaacaggctttgcagagcgttacggccttgatacatcttcaccatttctgcccttagactatcacgtaggtctgcggtgcgacctgcatgagtgccaaaagaatcatgaattactgcgatagatgtaatccctttatcaacaaggtcgcagaccgttaagataaggtgactggcatcatgaccgtgcacaaagttaggggcagcagcgcccatcatagccgtttcatccactacgtccgtttcaatctgtagactcatcttgatttctcccatcaagcaagtagatacgcggagcatatctgtcgccattatcttttgttgcaagatgaagccagtaggcaaggtgtactctaagccttcattccttttagctgcgaaacgtgcaagctgacgaatcattttcattgccactataggagctttaaccacttccgaaatagaaggccagattaaagctgtcatatagttataagctgcgctaggtgtcaggctgtccttacggtcattatcaaaagggtgtacaggattggcggtacgcccttccgcaatagcccgttgggcctctttttcttctaaatcaacgatataatcaatcactgactcacggcaggttagacgtgtgctgccataaggtagtgtcattacgggctttttggtcaggccgcgagtgattcctatcatataccacgcactagccatactacgcagctccgcacctgttaaagtcacgctgccagaagtgaaggtttccgcatcctctgcattcatgtatgcataattcttctgaattactacctgcgcaacggcaccataaatatcttgaggagagtcagagggcttaaggtttactgctttcgcacctacttcatcgcgtaacattgcgctatagtgctggataccagagcaactaccgtcttgatggacgggtaggtgcgtcatgaattggtcttgcgtgccttcatccagtgcatccagataacgcgcatattcaaagcaccatgcaaggaagccgtaaggggaatcagcatttacccattgagtgaaggtcagcgggtcggctgcaatatcgcggcacatgtcttgaaattcgccatccagcacgttagcggtgcgcacgtcaaaagttttcttatcccaaccccagttattcgccccgttcaccaaaaaccacttaagcgcctcagcgctatcaagacgctgcccttcggtaaaacggagcaatgccttgcctaagtcgtttgattgcggcgagagcgtgctagattgcgcataaacgcgcgaacggctgtccagtgcatacacaaaataaattgcgtcaaactggctgtatttacgggcctgtccaaccatgcgaacggtcgccgccgacttgcttccgcgcttagtttcagcggtatacagcttggtacattctcctttccagtttataaaagcttgccactgttctggcgtaagcatctctttcagttcacggcctctcaggtgttggaactcaagaggaacagggttagctggtttgttctcgcggtcaatgagcggcttaaaggaaggtacaccataaccgaggtctagacgaataacatcttctactacctgcaatacttccttgttaacctgccacttagtagcttgtaaggcgttaacagccttatagaccgctggcatttgctttttagttaacttacggacgtgctcacggttgcctttaacaaggcggatacggcttgctactttctcagtatgaaacccaccgttgaaaggtgaaacccacggacgcggaggaataacgcaaggtgcatatgcagggcttagttgcgctacgtgctctttgaaggcggttatccactcgccaacgtgttcactagtctgtaagtagtaaacaccgtgtttgccgccattagtacgcaaggtgcggatgaaaacaggctgcccgttgaagaatacactattttccagtatttctagcaaggtcataccaatttgtagcaaggtatctttaggccacgcttcccagcgagagaaatcagcgtcacggtcagctactgacttctcagccacgaccgctacattgtgcgcatggcgatatgatttagtcttacttgccttaagtgacttcttgaccttctcaaaatatttagctgcatggccttctagtttactgaagcgcacttggtcttcgatgcggtcagctacattcatagcgatagcttgcaaggttacatcagtgttaagcatatccattacgatcttcatcgtgatatacgctgccacttcattttctacgcagttaatgaaagccaatgcacgtggtgcacgaccgcgcttgccttcgtactcttccttataagcctgaataccttcagccattggcgcgattaactcggacaataagcggcgattccatgccgtgtctgattcattaccggatgcaatctggcgttgttggtccgcttcaaagcgacggataccgccgttaaacatttcttcttcaagttgaagttgaatagcgtgtaggtcttgcatcttgtttactcctagtgaaagaaaccttaataggtgacacctaagaagatgccaccgataaggttacttagttaattcttctactgcctcagagattaagggccatgcttcatggccttcgccgtagcctagcttaaccagttcgcggcgtgccttgttaactgctgttttcttcgttgcctcctcagcgcttaaacctaagcgagcatagaagcaggaagatttgaattgcggcagcataggcgcggctgctttcttgctttcgcgtgcgctgcttaaggaggcaatgcggtcattagctgcctgtaattgctcggtcagtgctttaatttgtgccagaaggccagcaatagcggcactctcggtgttagccgtgttatcccgtggcgctgcctttgtgtcttccgtcttgcttttgtcttcccacggtgcggattcgtcgttacccgactcacttgctggcggcacactttgtaactcctctttcgccttctctaagatgaaatcctcaaaggttgcatgtccttgcatagtttctgcggcctcagtcgcgttctcctgcggttttaccgactcaaccttagattgtaccgtctcggcctttgtctctttcttaggatcaatcagggcgtttacggcgttagtgtccagcttgccctctgcggcgagttctgcggccttctccatgattatattttcatcagcgaaaggaacaagcgccagcattacacgcatagccacacctttaaagcgttcgtctccttcaaagacacgggctacactcatcagcttgtagcattgtgctttcttgatgccgaactctgattctacataagctaaaaagtctttttgaccttcgaaatcaccgcgtaattcattcagacaagcgccaactttgatgtaagaagtgccgatattatccaaatgctgcttaatctcagcggttgcagcttcacggacagacaggaggatgttttcagtagtcataatagtcaccttatatagtgtaagtaaatatcacatagcccactcaggtaggctataggctagttacttgatgtaatgccacgtttctataaatgcatctttgctaatggcgcattccgtgccgttaggtgcaatgtattctacaagcccacctcttacacaaaggtaattaccgccttcctttcttagtttgcgtttagctttatcaaataagaactcacggtaaaggtgataggagcaccagcttaagccaataagagcaaatgccataatgatgctatctaaatccatagtcttaactcctagtaagtgaaagtttaatcaggcgctaccgtagcaacgccttgttaagccttctcttatagtgtcagctaaatagtttgtatgtagtgcctagtacttcctcacgaatttgtgcgaatcgtagggaacacttcagggttacaccgtctgaaaagataaagttgtatagcttttccatcttattcttcctcttcttcttcttctaaatattcggcggagttgatgtattcaacaatcatatactgaacacgttcccatagatcaattgtgagttgctcatagatacgggcttgcaatactaccgttacatccttagtgtctggcatcaggccggagtcttcgaagaaatgatcaattccttcactcgccatcacggagaagatgtcagcataatagattggtacagcactatccgccacatcatggattgcatcatgtgcgttatcaatacaatcaatagcatcattccagatacgttcaactaatgcagcatgagcggtgttgtaaacctgagagtaagtcatattagacatagccatgttattaatcctcatttagttagttaggttacattataggagactcaagagaatctcctaggtttaacctatccagactaagaagctaccatccaaattgttaaagagcttggtttgcgccttgataggctgactagtgccagcctttaccttaaatcagtgagaaacagccataccactctttgaagctagattggttttccagtggtaatatttcaagtttaccattgaccatacgttctacacaaattaaacctttcatgataattaccttagttagttagttagcctatcaagacacaaaccgtattgttaaagagcgggatgtttaaagacgtcgccgtcttgatgcttaatgtaaccttgtatgccgtggctgtcaacagttaatttagagatttgtcgtgattacttcatcgtaatcgtaatcttcactgcctagatactcagtaatgacttggttgtcatactcagatactaaggtaactcggtgatattcagtgtcgtaatctatcaaatagtgatacacatcaacgcctacaccagcttgcatcatatcatcacggaagcgaatagcttcgctagctgattcaaagaatacctcatgttgatacattatttaccctccctcaactcatctatcatgttacggtattgattaactgtatcggtccaaccttcgttaagaaagcggtgatacagtgccaactcgtcatctgtaagcaattcgttgttacgaatcatgtagcacaacagagtgaagagaacggatagttcacggttgtttaatgtcatagttaatccctcattcaataagtaattaaccacggcatacataggttacactaagcaaattgttaaagagcaatgtaagcactagtctcttcgtatgccttactagctggctactaggtgcctcagcaccgcctacgtgatgcatagtattacactaagattatcttgtcaacactaagttatcatcactaagaataagataggttgtctaacatgtgagactaaggaaaagcaatagatacagagctaggataggctaggttggctaggtttctggtgttcctcctactgcatcttattactatacttcttctttagcggtctaccgaccgcgacctaatggcatcttacatgcttgcatgtgcaatcactaagagaagacactaagacttactaaggtacactactaagctgatactaagataagcactaaggttataactaaggcagtccactaaggttaacctaagctatccatcaagtaataacctaaggtacacatcaggctaccgcagcgacgaacgaagtgaggagcaaaggaacagatagcccacccactcacaccctgtcaaacgcccaggaatggccctaaaacggcccgtgtaagccctaagcggttgaactaaggcaatcaccttgtccaatactaaggcgtgccctagcgcttcctaggcgttctccttgtgtaccactaagcgagtacaaggcaagccctaggccacccgtcgagcttcctgcggcagcaggttgaagacggaccagcccagcccaattcccaagccaaccgcagcgcggccccatatgggggaaatccggcgagggcgagggcgag

SEQ ID NO: 5 - DNA, 39853 bp, artificial sequence
  BP953
aaccttatgagacttgatgtaccccttaagaatcctacagaaaaatctgagtgggtatctcatagttcatacaaagtgtttcccccctatggcctccttcagttaccccaaagagtcggcccctatggtaactttatgtttacttaatgtcaatccttatgtgtgacattgggatgactctaggtgttaccactagatatagtgcttagtgtgacttagtgatactatatgtagtcctctatgtgtccctatctgtaagtgacctttgagtcatcaccttatgtttcctctttgagttaacaccttatgacctccttatggctggctatccttatgttaaccttcagtcggtgccttatgtttatcagtgaccagtaggctacgtcactaagagaatcactatcttactctgtttagcagtctctgagtaatgagagagacaattagaattgactgagtgcttatagtgccttaaaggtgacttatagtcaatagcctttatacgactcactaatgggatagtgtctaattataatcccttccttatagtgctaacttaaagaccacttaaagataacttaaagtctaactaaggggttgactctaagaaacagctatggtttaatggctaccagttgagagacacaacgctaccaactaccagacaagacctagagttatctggtaaggctgaagggtctcaagtagtcatcaaccagacatacgaaagtggttgactcaacgaaagcaataacgtagtatagcagtcgtcaacaactggtcgccctctgaaacaacaatgaggtgtcacggtgacaaacaataggttgacaagtagtaaagataagatgtaagatgtatgacataacgttcttgtgatgtcccacactgaaagggactcggtgctaacgaagcctgcacttaaagctctttaacaatttggataataagcactcttgagatgacgacaacagcgattaactcaagggtacacaacaagcaacaacgtgtgtactctttatgataatcactgcaaccacataaggtaatcatcatgattcacactaaagagcaagctaacgttttctatgtactggtaagcgcattccgttctaacctgcaccacttggataaccttagccgtcatcgtcgcttagttaacagcttacgcaatgcacctctggaatacggtagcgtcgagtctacagacttaactggctgttaccatgaggctggcacggagtcaccttctgaagaacagactatccgtgttcgttgcacgactaaagctcaagctatcagcgttgcacgtctggcatgtaacgactacgaacaagattgcgtactggtctataagtcacagactcacagcgccgcactgatatttgctggtggcttggacggctggaagactgagcgcatcggaacgttccagatggtcgcacctgaagttgaactgaccgggaactacacggtcgatgagttcggacgtggctggatggtggtttaatggtcatggcactctttgtaatcactgtgtacgctctgattggggcgtacttcctgaaggacttcacaaagggtctgaaggtacacaaggctaacttctcgcacctgaagtatggctttctccctcgattcacagtccgtgaacgtaacgggcgctttaaggctaacaaggttggtatcttctatgttgcaacacactgatagtttaactaagaaagtcctgtacgcactggcatatggtgccaccaacaagacgctaatgaaggtactgaacacagagcgtctacctgccagaaaggtagcaaaggcacgtaaagaagcacgtttaattcttaattctctctcttaaaggacacaatctaatgaactacaccgacattcaggcacgtctggcaatcatcaagtcactcccgattagcgaactggacaagcgccagcctcttctggttgcactggctgctgacatcgtgaacggtgagacaagcgatggcaacgacacagacgggtcgcagggtcttgagtatcaggactggtggcacaccttgggtgcactaatgcgtgatgctgggttccgcatgttaggcaatggtcacttcagcgcggcttactcgcacgaaatgttaccgggtcgagtcattaaggttggctttaagaaagaggattcaggcgctgcatatactgcgttctgtagaatgcaccaaggtcgagcgggtatccctaacgtctatcacgtagcacgacatgcaggttgctatacggtcgtactggaccgcttaaaaagctgtgaccgctacgctaacgatgtgcacgcaaagtatgcaagtgctgcgcaggagttcattgagtgctctggaggcgatgccgattggtacgcacagtatgttagcaaggagttcattgagacatgcaagatgattcgtgagttcttccacggtattgcatctttcgacatgcacagtgggaacatcatgttcgatgagaacgatgtggcttacatcactgacccggttagtttctctcatgaccgtgaacgtggggacggtttccctctggaccctgaagcactgctggctgaggtcgaggctgtagcgcaagagcgtatgattgaacgttgtcgcaaccgcaaggccaagtgtgaccctaacggaacctttcaggttaaccgcaaggcagcaatgaaacgccgtaagcgtaaccgtaagttacgtgctaaacatgcagcggaaggaatgcaacagtttgtcaaagagcgtcttgagcgtagagctattggccgaaatgaacgccgtgctgagatgttcatggggtctggctggcatgacttctggttacgcaacggtaacacactggtacgcaaggttgaccaagtgaacggccttaagtggcaactaggggaccgattagcaatacaagcgggtctacctctgaacattgacaagttacttgacgcacaactgcaaggctgataaggtgtatcttcaaggtcggcactgactgctgacctttatagataaactttcttaacaacgaggcacacaatgactaacgtaatcaacgcaccaaagaacgacttctctgacatcgctaacgcaatccagccgtacaacattctggctgaccactacggtgcacatctggcggctacgcagttacagcttgagcatgaagcgcacactgagggcgagaagcgtttccttaaggcaatggagcgtcaaatcaaagctggtgagttcggtgataacgcagtggctaaaccgctcctgtcatccctcgcaccgaagttcatcgaagcgtggaacacttggttcactgaagtagaagcgaagcgtggcaagcgtccagtagcctacaatctggtacagaaggttgcacctgaagctgctgcgttcatcacactgaaagtcacacttgcttgcttgacgaaagaagagtttaccaatctgcaatcggtagccactaagattggtcgcagcattgaagacgagttacgttttggtcgcatccgtgacgaagaagcgaagcactttaagaatcacgtacaggaggcactgaataagcgcgttggtatcgtctacaagaaagcattcatgcaagccgtagagggcaagatgcttgatgctggtcaactgcaaaccaagtggactacatggacacctgaagaatcaattcacgttggtgtacgcatgttggaactgctcattggttctactggtctcgttgagttacaccgcccgttcgctgggaacattgagaaggatggcgagtacatccagttaacagaacagtatgtagacctgttatccaaacgtgctggcgctctggctgcaatcgctccgatgtaccagccttgcgtggtccctcctaagccttggacttctccggttggcggtggctattgggctgctggtcgcaagcctctctctctggttcgcactggtagcaagaagggactggaacgttacaacgatgtgtacatgcctgaagtttacaaggcggtgaacatcgcacagaatactccttggaagattaacaagaaggttctggcagtggtcaacgagattgtgaactggaagcattgcccggttgaagatgtacccgctctggaacgtggagaactcccggtcaaacctgatgacatcgacaccaacgaggcatcactcaaagcgtggaagaaagcggcctccgcaatctaccgcaaagagaaggcacgagtgtcacgccgcatgagcatggagttcatgttaggtcaggccaataagttcgcacagtttaaagctatctggttcccgatgaacatggactggcgcggtcgagtgtatgcggtcccaatgtttaacccgcaaggcaacgacatgaccaaaggtctgttaacgctcgctaaaggtaaaccaatcggtgtcgatgggtactactggctgaagattcatggtgctaacactgctggcgtggacaaggtggactttgcagaacgcatcaagttcattgatgacaaccatgagaacatcatgagcgttgccgctgacccgattgctaacacttggtgggccgagcaagattctccgttctgcttcctcgcgttctgctttgagtatgcaggtgtgcaacaccacgggatgaactacaactgctctcttccgctggcgttcgatggtagctgctccggtattcagcacttctccgcgatgctccgtgatgaggttggcggtcgtgcggttaacctgttgccaagcaaagaggtacaggacatctaccgcatcgttgccgaacgtgtgaacgaaatcctgaaccaagatgttatcaacgggaccgacaacgaagtagagaccgtgaccaacaaggacacaggggaaatcactgagaagctcaagctgggtactaaagaactagctggtcagtggctggcctacggtgtgactcgcaaggtcactaagcgttcagtcatgacgttggcttacggttccaaagagtacggattccgtgaccaagttcttgaggacaccattcagccagctatcgacgatggcaagggcttgatgttcactcaaccgaaccaagcggctggctacatggctaaactgatttggaacgcggtaacagtcacagtggtcgcagcggttgaagcaatgaactggctgaagtctgcggcgaaacttctggctgctgaagtcaaggacaagaagaccaaagaggtacttcgcaagcgttgcgcagtacattgggttactcctgatggcttcccggtctggcaggaatacaagaagccagtacagacccgcttgaacctgatgttcttaggccagatacgtctacagcctaccgtgaacaccaacaaggatagcgggattgatgctcgtaaacaggagtcaggcatcgcacctaactttgtccactcaatggatggaagccacctgagaatgactgtagtgcgctccaatgaggtctacggtgtggaatccttcgcactgattcatgactcctttggcactatcccggctgatgctggcaacctgtttaaagcagtgcgtgaaacgatggtcaacacttacgaagagaacgatgtacttgcagacttctatgaacagttcgctgaccagttgcatgagtcacagcttgaccagatgcctgagatgccagctaaaggcgctctggacctgcaagaaatcctgaagtcagactttgcgtttgcctaacggaatctaatacgactcactattgggagccttcgggcttcctaaactttaagatactttaagttctaactttaagaggaaacacaatcatgtttactttaatcacttcagtaggcgctctcgtatcaaccattcttgcagcaacatactataatcgttcaaaggtatttctcactaagctaatcaaagaagagaagaactctcatgcactcaaagagagacttgaagatggatggcgagagaagcaggaactagctggtcgaatccgtaccttagagttcgaacaacaatacgacatgtcgaaccaacgagaactcattgagcgtctacgcgctgaggcagtggagtaccgcaaggaacttaaagaggcaaagagtatcatccgtgagtacactcacagtgacatcacgtctatcaagtttactgctcacatcccggatgctggatggaagcgcactgagttcaagctaggcatagggtcttgcggcaaagaggttacatgtttgcactggaaagaacagtcggaccgctacctgctgacacagacatgcactgatggtgagcgcaaagagttcacctattataagaaagacgtagctggtcgcattgagattgcacgtaaggttgcagacaatacgactcactaatgggaaacactgaaagttaaactcaaggtcatcacttctggtggccttcatgattaactgtcaacaaactatacacacagaaggaaacaacattatgcgtaccaacttcgaaccaactaccaagcgcaacaacgtaatcaacgaacacggtgctgaatggcaggaacgtaaagaccgcatgaagaaacgccacaagacacagcgtggcaactctgagaagcgcaactggaaggaggcactctaatgggtcgcttatacagtggtaacttaatggcgttcaaggatgccatcgcgagacttaaagaagaccatgatgtccgtgtggtcactgagactttccgctataataactatgctaggatgcgctgggtatccggtgagactcttcgagtggtcttgcggaatggcgtagtgttaacctctgagcgtttcgaacaagacgacgcagacgttcgctgcaatgcacagactgagtggctccgcaaggtacacgcagacctgaagcactggaagtaatacgactcactattgcgaaagagttaaactaaaggtcatcttcgggtggcctttgtgattaacttttgattacttattaaccgacacactaaaggagttccatcatggaaatcacatttaagacttcgccgttcaaagcagtatcctacgttgagtctgccattaagaaagcactcgacaaggctggctacctgattgctgacactaagcatgatggtgtacgtggtaacatcgtggttgacaatacggctgactgcctgtggctgtcccgtgtctccaagaccatccccgcgcttgagcaccttaatgggttcgaccaacgctgggctaatgttctcaaagatgaccgctggattttccctgatggctttatgctggatggcgaactcatggtcaaaggcgtagacttcaacacagggtctggcctactgcgtaccaagtggctcaagaagacaaactgtggatttgatattggtggagtagaacctctcaagggtagtaaagtagacttctgcttagaccctaagaaactcaaggttgtcttgtatgctgctatgccgtatcacgatatggtagaaggcaaagagtacggagttatgtccctcctgatgcaagagcatgtgcgttccctcattccggttcttagtgaacacttcccggaaatcacttgggaactctctgaggccaaagaagtctacgacatggtagaacttcaggaactctacgagaaagctcgcgccgatggtcatgaaggtctggttgtcaaagacccgctggaagtctataagcgtggtaagaagtctggctggtggaagatgaagcctgagaatgaagctgatggtattatcgttggcctcaattgggggactaaaggtctcgctaatgaaggcaaagtgattggcttcgaggttctcttggagtctggtcgcgtagtctctgccaacaacattagccaagcgttgatggatgagttcacagatgcggtaaaacatgctgagtctgtaggcatgggcatgccctacactggctttgcctgtcaggtagcgtacatggaggaaactccagacggctctctgcgtcacccatcgttcgtgatgttccgtggcactgagagtgacccaacggagaagatgtaatgcttatctttgacaagaatggctggagagtgcatcaacacccacaccttatgatattccacatatcaaagtggatggaaggagatgattggagaagctacaggagaacttgggactactttacagtccatgagtgccgtagcattgaggaagtcaaagattacctacgaaacaatatgtaaagataaaccaacggtcagtccttaacggggctggcctttttgcgtttctattcgactcactatggaggaacaacctcatgctatttctaattgctgctgctatctttgccacgtttgccttcgttatcattgacgacaactgctggcctgattgctaatacgactcacctatggaggaaacacttatgttacgactacacttcaacaaatcaaacggtatcttttcggctcgtggttccgaccgctcgacggttctggcctccgagaaacatgcagtcattcctaaagtgcttggctcgaccattgagttagcacctcgtgttcacgctgtgattacgactggcttatataaagaagcgatcactggctcccggcctttcattccggttctcgtcacccgcttccctaaagtccgtctggtcattgcgcgtatcaaggaggtgttctaatgtctggttgcatcgcatgtttagagaaagatgaccgctacccgcacacttgtaaaacaaagcataccagtgagtgtacaatctggaatggtgctggtgtgtgtagctgcactaagtcagacaaaccacaagatatagatggtgtgcgcgctccgagccactatatgttgtttgacgacattgaggctatcgaagtgattgcccggtcgatgacccgtgaacagttcaaggggtactgcttagggaacatccttaagtaccgcctacgtgctggtaagaaatccgaactggcattcttagagaaggacatggcgaaagctgggttctacggtgaactgtatgagaaacataaaggtaaatgtcatgcttaacgatgtgctttattttggcctaatttgtgccgggatgggtacactgcttcgtttaatgtattgggctatcgaggtggaatatggaaaagcctagcgaatggtgtgagcgtatgtttgaaaagacaggcaacaccgactaccttgaattatataatcactggaaggagagaggacaatgagcactctgaataaagggtcactggtaaacggtgacaagaagttcttcgcaacggtcgaaggccaaggccaatcgttcgaagtccctgtgttcgctacgtctcttgaggaggccaatgagttagctgagtggcaatacgtccctgctggcttcgctgtaacacgcatccgtccagaccgtaaggtttaataggactcactaatgggagacactaccgtttcccacttttaactttcagaaactttaaaggagaatcattatggcattcgcaaaacgtaaagtattcacttccgctcgtggtgttgctgaaccttactgctatctggcaaagccggacttcggtagcggtgacttcaagaacgaacgtggtgtctacaaagtgtcacttactgtatccaacgacgaccctcgctgtcagaagatgattgacgagattgtcgaagcccatgagacggactatgctgctcgactcgaagagtacgaagcgaacccgccgaaagttgtcaagggcaagaaaccgctgaagccatatgttggcgacatgcctttcatggataacgaagacggaaccactacgttcaacttcaagtgctacggctcgttcactgacaagaagactggtgagaacaaaccaatcgacttggctatcgtggactccaaaggtaagcgcattcgtggtgagcgtccagctatctctggtggctctgaactgaagattaaatacactctgttcccttacggatggtctgctgtggcaggtgcttccgttaagctgcaactggattccgtgatgctgattaagctggtcgagttcggtggtggtgatgacgattggggtgatgaaatcgaagaagacggctacgaagctgatgaagcacagacccgcaagcctcaaaacgactctggctggaatgaagaaccagaagaggacgatgaagacgaagacggtgatttctaatggctaagggctatgcaggtcgaggcactcgtgtgggtgcctttcgctctggcttggaggataaggtaagcaaacaactcgaagggaagaacattaagttcgactacgagcgttggcgtgtaccatatgttgttcctgcaagcaaccatacctattgcccggacttcctgttacctaatggcatctttgtggaaacaaagggtctgtgggatagtgacgaccgcaagaaacacttacttatccgtgaacagtatcctgaacttgatgtgcgcatcgtgttctcttctagtcgctccaagctgtacaaagggtctccgaccagttatggcgagtggtgcgagaagcatggcattctgtttgctgacaaattaattccagttgattggcttaaagagccttctaaggatgttccattcgataaatttaaagaggtgaagaagaaatgagtaaggtacaattcaaaccacgcgctgtgacagaagcaatctttgtccactgtagcgcaactaaggcgaccatgaatgttggtctgcgtgaaatccgtcagtggcataaagaacagggctggcttgatgtaggctaccacttcattattcgccgtgatggtacaatcgaagaaggccgtccggtcgatgtcgttgggtctcacgttaaggactggaacagtaagtcagtcggtgtgtgcctcgttggtggtatcgacgataagggcagacacgaagctaactttacgccagcacagatgcactctcttaaagagaaactggcagacctgaaagacctgtacccggatgcagaaatcaaagcgcaccacgatgtggctcctaaagcgtgtccaagttttaacttgagtcgctggctgaagactggtgaattagtaacaagtgattggggataagattatgatgattattcatgagatgggcatgtacgatatgatttaccgctgtgtattcgttctggcattgacctatatcttaactcgtaagtaatagaactcactatgggagagccgaaaggtttctccctttgttcgctaaaattgtataaggagtaaccactatgcgtaagctatttggtgaagcacttccggtgacacttctggtcatcgtcattatcgtttgtggcgcactgcgtccgttcctgtaggagtcctatcatggatatggaagaacaacaagagagtatattcctctatcatttaccttgtgagaactgtgggtcgtcagatggtaatggcatgtattctgatggacaccagtattgttttgtgtgtcagaaccatgtgcgtggaaccgaggaaactcgtgagaccgtggcgaagactcgcagaagctcatacaacactggaggtgacaaaatgtctaacctgttaaactttggggattcagatggtcgctatacgaacctcaaagctcgtggccttatggaagctatctgccgtaagtatggctattgggtagcgaaggtcaacggagagatgcttcaggttgcgaactactatgacgttgagggaaatctcgtaggtcagaaagtgcgcgacaagaacaaggagttctccgcaaaggggaaactcaaagctgacctattgtttggtaagcagttatggaatggtggcaagaagattgtggtgactgagggtgagattgattgtctgaccgtagcgcaacttcaagaagggaagtatcccgttgtgagtctccctatgggtgctcaagccgcaaagaaaacatgtgctgcaaactatgaatacttcgaccagttcgatgagattatcctgatgttcgacatggatgagccgggtcgtaaggccatcgaagagtgtgctcctgtcctgcctagcgggaaagtccgagtcgctgtactgcctcttaaggatgccaatgagtgtttgctcaatggacaagccaaagcagtaaccgaccagatttggaatgcgcaaccttgggtgcctgatggcgttgtctctgctgtgtcacttaaagaccgtgtgcgtgaagcgatggtcaaagaggaaacaacaggtctgctctttacgggtcaacctaagctcaacgatatgacgcttggtgctcgtggtggtgaagtcatcatggtcacttcaggttccggtatgggtaagtccacattcgttcgtcaacagatgctcatgtggggcaagggtggtgcgaaggtaggcttggcgatgcttgaagaagccgttgaggaaactgttcaggacttaatgggcttgaacaaccatgtccgtctacgccaagacaaagaactcaagatgcaaatcttagaggatggacgcttcgatgaatggtacgacgtactgttcaacacagatatgttccacctgtatgattcctttgcggagtcacaggaagaccgtctgttcgcaaagctggcctacatggtcgatggcttagactgtaacgttatcctgctggaccatatctctattgtggtctccgggatggaagataactccgatgagcgtaagacgattgaccgactgatgaccaagctgaaagcctttgcgaagactaaaggtgtggtcgtggtggtaatctgtcacctcaagaatcctgagaaggggaaagcacatgaagaaggtcgtcccgttagtattactgacctgcgtggttctggcgcactgcgtcaacttagtgataccatcattgcccttgagcgtaatcagcaaggtgactatcctaatcttgtccagcttcgtgttctcaagtgtcgctttactggtgatactggcgtggctggacacatggcctacaacaaagaaaccggatggcttgaaccgactgtctcacctgaagatgaaggagatggagatagcggctgggaaccagaagacgatggtcaagacttctgatagccattgggtagaccagtgggaagaactgaacgagcgcgaacaggcgctctacagaaagcaatcaatacaactcactaatgggacagacaccctgttcccacttatcaatccacttaaggagaatcacaatgtttaaattcatcaacactctcggtaaactggtagttaaaatgtacttccgtgaagctaaacgtctgaacgacaaggcacgtaaggatgcagaacaggctcaacgcttggcgaaacaggcacgtctgctgtctgaagatgcaagtgctggcgttacgtctgctgctaagattgcagcgaaagcaaccgacctgaacaagttcttcctgtgatggttacgataacccttgtgctcactctgataactgtgagcggacaaacaataagtcaagtccctttttttttcaagcagaagacggcatacgagatatgcgaacagcaagggcgctcatggtctaaggacttgatgaagaacggcagggttttcactgccaactacaactgtatctaataggagtacacaacatggctattaaattccccggcaacacaatccgtctgtctgacaccatcgaccagtatgctcgtcgagtgcacatcaacgttcgaaacggcaaggtcactttggtctaccgttggaaggaccataagtccaccaaggcgcacacacagcgtgtgactctggatgacacacaggcaggtcgtctgctggcttccgttgctgtagctgccactgtggctgtaggtgaagacaatgttcgtcaggttctgctgggtaagaccgtagagtctgagggcaacatgcttgctgacaagtgtgaagaataagagttaaactaaaggtcatctacatggtggccttcgtgattaacttttgtatgaaatctattcaactcactaatgggagaacaacactatgcgtaatcgtaatgtaatcgaagctgaaatcgctaaactggaagctgaactggcagacgttaaagagtatgaatgtgctcgtgactccgctgtccacatcctgaagaacttagggtggacccgcaagtatggcaagtgggtcaaaccagtaaccaatagtggtagcgttggtatgcagactttcgacgcagacaagatgacccacattaaggctggggacttctgcacctccaccagcaacgcagacatttggtatgtccgtaaggtcgaggggacagacatttggtgctcccgtgtgactcgcattgatgcaatgggtacagtcgctgggattcagtatcacaagatgaaccacaagaacctgcgtgtggttgaccctaagaacttcatgggctaccgcaaatctacattttaaggagtaaacacaatgttactatccgacatcgaaacaaacgggttgctgcacaacgttagtcaatttcactgtgcggtgacttacgactacacaaccgaccagtacatccgttaccgacctgatgactttggggcatacattgatgcactcgaagccgaggttgctcgtggtggtctcattgtgttccacaacggtcacaagtatgacgttcctgttatcgagaagctggcgaagctgattctgaatcgtgacgttaagttcccgaaagagaacgtcttggacaccttagtgatgtcccgactgatttactctaacatcaaagacactgatgctggtctgctgcgctctggcaagctgccgggtaaacgctttggctctcacgctcttgaggcgtggggctaccgcttaggtgaaatgaagggtgagtacaaggacgactttaagaagtcactggaagagtctggtgatgaatacgaagaggggatggagtggctgttcttcaacgaagacatgatggagtataacgttcaagacgttgtagttaccaaggcactcttcgagaaactgtgtagcaacacattctatttccctaacgagacacctgctggaagcacagaagcagaacgtttctggaacggtagccttgaggctgtcaaactggaacacgatgctgcgtggttgttagccaagatggaacgtaacggtttccctattgacatcaagtccttagagaatctctacgctgaactggctggtcgccgtggtgaactgctggtcgaactgaccaacactttcggctcatggtatcaggctaagggtggcgttgaagcattccgtcatccgagaactggtaagcctctcactaagtatcctcgtgtgaagtatccgaaacagggtggcatcttcaagaagcctaagaacaagaagcaacgtgaaggtctggaaccttgtgaactggacactcgtgattacgtagagggcgcaccttacacgcctgtagagcacgttgtgtttaaccctgctagtcgtgaccacatcactcgtgtgcttaccaaagctggctgggtgcccgttgagttcactcctagtggtgcaccaaaggtagacgatgaggtcttagagcacgttaaggtagacgaccctgatgcacagcgttgcattgagttgattaaagaataccttatgattcagaagcgtatcggtcaggttgctgaaggtgataacggctggctccgaatgattggagaggatggtcgtattcacggtagcgttaacccgaacggtgcggtaactgggcgtgcaactcatagcttccctaacgtggcacaggtgccttctatccgcgctgcttatggtgaaccttgccgtgctgctttcggtgccgagcacaacatgaaagacggtaagccagacccttggattcaagttggtgtggatgcgtccggccttgagctacgctgcttaggtcacttcatgtatcgctatgatgagggtgagtacgttgagaccatcctaacgggtgacatccatacgaagaaccagatggctgcgggtctaccgactcgtgacaacgctaagacgtttatctatgggttcctctatggtgctggtgctgcgaagattggacagattgttggtggtactgccgaagacggtaagcgactcattaagaacttccttgagcaaacccctgctatcgctgcattacgtgaagcaatcacagggacactcgtcaaggactctaagtgggttggaggcgaacagaaagtaacttggaagcgccgttgggttcgtggcttggatgggcgtaaagtccacgtccgtagtcctcacgctgcgttgaacaccttgttgcagtctgctggtgctctgatttgtaaactgtggattgtagagactgagcgtctgttactggaagctggcctgaagcatggctgggatggtgactttgcgtacatggcatgggttcacgacgaaatacaggttgctgcccggactcaagagattgccgataagattgtcgagttggcacaacaagcgatgcgtaatgtgggagaccactttaactttagatgtcagttagataccgaaggtaagactggcgcaaactggaaagattgtcactaatacaggagaaacatatcatggctattactaaacgttttaaagtatcattcgaaatgaccgttaaggttgactctgagaccgaagctatgattcaggaatgtatcttagacttggctcgtagcgttcgtgatggtgagaaagttagcgcacaggacaaagagttgctcgttcaggctctgacctacggtgccgatggtgctgtggcctttgctgttaagaagggtgtccgtaatgaaatccgtgagatgggcattgagcaccacggtgagggcatcaagttcgcaccagcaactatccgtgaggtgaagtaatgggtgaatatctacgagtactggcggctatcaaaagctgccctaagacctttcagtcgaactatgtgcgcaacaatgcgtcactggtggctgaggctgcgagtcgaggtcatatctcttgcctatcagtcgatgggcgtaatgctggcgcttgggaagtaacaggcgctggtgtccgattcctgaagaagatgggaggttgtgtatgagtttgcataccgacaacgtacaggtgacccgtgaggcgtggaatgacatgcaagcatacattcagtcacttgagaaagaccaagagttcctgaatgctctgagagcctgtggcgtggacaattgggatggttatccagatgccatcgaaatggtctacggggaggacgacttatgagcgcaattacactgaaggagttctacgagttacgccaagggaaatccgataagggtgttctcgtaatggatggcgactggctggtattccaagcgatggcagcaagtgaagtcgagaccgattggggtgacgatgtgtggaccttagagtgtgaccacgggaaagcgtggaacattctggttgactctatcaagtcctatgcgagccgtaagaaggcttggcgtgatgcacctatcgtactggccttcactgactctgtgaactggcgtaaggaactggtggacccaacctataaggagaaccgtaaggcatcccgtaagcctgtaggctaccgtgcgttcgtcgagcgtgttcaagcctgtgaggactggacgtctatccttgaggaccgacttgagggcgatgacgtaatgggaatcattgggtctggtgctaaacactttggtttcaagaaggctgtgctggtctcctgtgataaggactttaagaccatccctgattgtgacttcttgtggtgcactactggtaacatcttgactcaagaccagactactgctgactactggcacatctatcagaccattaaaggtgacttgactgatggctatggtggcattccgggctggggagagactaccgctgagtggcttgagaacccgtatgcctttgaacaggttgagaaaacctttaagtctggtgcccgtaagggtcagacggttctcgaatggaagaaggtcgacatgggtgagcgaaccttatgggaagcgattgtgaccctcggtgccaaagctgggatgaccgaagaggaaatcattaagcaaggccagatggctcgcatcctgcgtttcgaagagtacaactttatcgacaaggagatttacctatggtcgccggaacagttgcgttcgtaatgttcgcaatcgtagccttcgctatggtgtgggctgcatttatagctaagagggtgtaactctaggcattcttctctacgtgaaatcaatacgactcactattggagaggggtgcctatatgatacctactttaagttctaactttaaggagaacattaattatgttaacccctatcaagaagtatatggagaacccacaagatattcctaatgttcctcggagtgttatggagtatctacaggttcaatacaatgctggatatgctattcagtcaggtctaatcaaccgattgaaacaggctggatggtctgaaagctacattgctgggttccttgcgggtctcaactatgcgtcccaaactctggatgacatggaggcaatccgtaaggaacaggctgagtcctaatcgtatggaggtcttatgtgcttttcaccaaagattaagacacctaaagtaaagacagatactgtccgagctattgacccagcgccactgactgaggaaccgaaaggtattctctttggaggcgatgaggacaccgatagcggaacctcgtctgaggtgccaacgggcggcaagaagtcgcttaaggtgaaactggatgactccgttgagaaatccaagaaggctgatgatgcagccaagaagaagtccaagtctggtattcgtaccagtgtctttaagaagaaataattaggaggtgtatcatgggttggggcaaaaagattcgcaaatcagtcaagaaggctgtcaggaaagtaaccaagcctgtagagaaagctgttaagcaggtcggtaaggctggtgaagacatcgttaaaggtgctgctggtgtcgttagtggtgttctggctggtggtaagcctgctgtacaggctgcacctccggctgcacagattatcgagccaccgagtaaagacgatgtagactccgatgatgatgcacagactgaatcaggtaagaagaaagcccgtgctggcggtaagaaatctctaagtgtcgctcgcagttctggcggtggtcttaacatttaataaggaggcactatggcaagctcacagaaacgtgaaggctttgcggagaatggtgccaaggctgtgtatgacgcattgaagaacgatcggaactcctatgagacccgtgcggaaaactgtgcgaagtacacaatcccctcgttgttccctaaagactccgacaacgcatcaaccgactacaccactccgtggcaagcagtaggtgctcgtggactgaacaacttggcctctaagctcatgctcgctctgttccctatgcagacttggatgaagctgaccatctctgagttcgaagcgaaacaattggttgcacaacctgctgaactggcgaaggtcgaagagggtctctcaatggtcgagcgtatcttgatgaactacatcgagtcaaactcataccgtgtgacactctttgagaccctgaagcagttggtcgtagcgggtaacgctctgctctacatcccggaacctgaaggtacttacaatcccatgaagttataccgactgtcttcttatgttgtccaacgagacgcattcggcacggtactacagattgtgaccttggataagactgcctatgcagcactaccagaagacgtaaggaactctatggactccggtacggaacataaaggcgatgaaatgattgacgtgtatactcacatttatctcgatgaggaatcaggcgaatacctgaagtacgaagagattgatggagtcgaagttgatggtacagatgcttcttatccggtggacgcttgtccttatatcccggttcgcatggtacgcattgatggggaatcatacggtcgttcatactgtgaggaatacttaggtgacttacgttcccttgagaaccttcaggaagctatcgtcaagatgtccatgattagtgcaaaggttatcggcttggtaaacccggctggtatcacacaggttcgacgcttgaccaaagcgcagactggtgacttcgtgtctggtcgtccagaagacatctcgttcctacaactcgaaaaggctgctgacttctccgtggctcgtgctgtgagtgaacagattgaaggccgactgtcctatgcctttatgttgaactccgctgtgcagcgtactggtgagcgtgtgactgccgaagagattcgttatgtcgcatctgaacttgaagatacccttggtggtgtctattcgattctctcacaggaacttcagttgccaatggtgcgtgtcctgctgaaacaacttcaagcaaccaatcagattcctgagttaccgaaagaggccgtcgagcctactatcagtaccgggatggaagcattgggtcgtggtcaagacctcgataagctggagcgttgtattgctgcttggtctgctcttgctcctatgcagaatgaccctgacatcaacattgcgaccattaagttgcgcattgcgaatgctatcggcatcgacacttctggtatccttaagacacctgaagagaagcaacaggagatggctgaggccgctcaaggcactgctatggagaacgctgctgcgtctgctggtgctggtgctggtgctctggctactgcaagccctgagaacatgcaagctgcggctgaacaggctggcatgatttaatacgactcactaatgggagagacaatacgtcctccctttgagttcaaactttaattgaaggagattacaattatggctggtgaatctaacgctgatgtatatgcatcttttggtgtgaactctgcggttgtcggtgggtctactcctactgaccacgaacaggctatgcttgaactcgacgttgctgcccgtgatggtgacgatgcaatcgagttagtaagtaacgatgacccgtatggcaatccagacccgttcggtgaggaagacgaagaccgtactgagattcgtatctccactgatggtgaacctgaagtcaacgaagacggtgaaatcgaatacgaagagacagaaggtgacgaagctgatggtttcgaacctgtgggcgacattccggctgaactgaatgaagcctcaagtcaactcgaagagcacgaagctggcttcgaagagatggtcaatcaggcggctgaacgtggtctgtcagaagacaccattgttcgcatccaacaggagtacggtgaagatggtctgtccgaacagtcttatgaagaactggcaaaagctggctactctaagtcgttcgttgactcctatatccgtggtcaggaagctctggtagaccagtacgttaagtctgttatgcagttcgctggcggtgaagaacagttccaagcaatttatagtcacctcgaagtatcaaaccctgatgctgccgagtctctgattagtgctctggaaaatcgtgacatcgctacagtgaaggctatcgtcaatctcgctggtgcaagccgtgcgaagactttcggtaaacctgctgctcgcagtatctctaaacgtgccgtacctgctgcacctgtgcgcaccaaacagtctggctttgagtcacaggctgagatgattagtgcaatgtctgaccctcgctaccgcacggactctaagttccgcgcagaagttgagcgcaagatgatgtacagtcagttctaaaattaatacgactcactaatgggagagacaatacgttctccctttgagtgatacacaatgagaaccaactcgtttcaagtagtacctcacacatttaaactttaaatcaacagaaggagattcaacatggctaagatgaatggtggtcagcaaattggtaaagaccaaggtaaaggtatgtctgctggtgataaactggctctgttcctgaaagtgttcggtggtgaagttctgaccgcgtttactcgtacctctgttactatgaacaaacacctcgtgcgttctattcagtccggtaagtccgcgcagttccctgtgctgggtcgtaccaaagctgcttacctgcaaccgggtgagaacctcgatgacaaacgtaaagacatgaagcacactgagaaggtcatcaacattgatggtctgctgactgctgacgttctgatttacgacatcgaagacgcaatgaaccactatgacgtgcgctccgagtataccgcacagttgggtgaatctcttgcgatggctgctgatggcgcggttctggctgaaatggctaaactgtgtaaccttccgtctgcgtctgatgagaacatcgctggtctcggtaaggctcatgtactggaagttggcaagcagtctgatcttcagggagaccaagttaagctgggtcaggctattatcgcacagttaactctggctcgtgccaagctgactagcaactatgttccgtctgctgaccgtgtgttctacaccactccagacaactactctgctattctggctgctctgatgcctaacgctgcaaactatcaggctctgattgacccgtctactggctctatccgcaacgttatgggcttcgaagttattgaggttccgcatctgactgctggtggtgctggcgaagaccgtccagaagaaggtgtaaatccgactggtcagaaacatgcgttccctgagacttcctctggtgacacccgtgttgctctggacaacgttgtcggtctgttcaatcaccgctctgccgttggtactgttaagctgaaagatatggcactggaacgtgctcgtcgagctaacttccaagcagaccagattatcgctaagtacgctatgggtcacggtggtctgcgccctgaagcatgtggtgcgctggttttcaacaaggcttaacttctcgcaaactcgtaggggacactgagtcccttactgaagttgagcaagagctaacgccacaacagaaagctgcccgtacccgtgcggcaaacaaggctcgaaaggaagctgagttggctgctactgaatgataactatatgaaaccccttgggtgccttcgcgggtgcttgaggggtttttttcgtaccactaatagactcactaatgggaggaaatcactatgcgttcctatgagactaccctagagactggcgaagagttggctgcggtcaatgacatcttggcctctatcggtgaaccgcctgtgtccactttggaaggtgatgctaacgccgatgttgccaacgctcgtcgagtgctcaataagattaaccgtcagattcaatctaagggctggacgttcaacattgaggaagaccaacagttacttcccgatgtgttcaacggattgattccctacatgtccgactacctgtctgtgatgacaccgggtggtgctactgcctatgtcaaccgaggtggttacgtgtttgaccggactactggcactgacgtgtttcagaacccaatcactgtgaccatcatcaagctccgcgagttctacgagatgcctgagtgcttccgcttctggattgtcactaaagctgcccgtcagtttaacaacaggttctttggtgctcctgagattgacgcagtgttggctgaagaagaacaagaagcgaagatgcagtgtcacgagtatgaactggacttcggtaacttcaacatgcttgatggtgatgccttcactggtggtctactgtctcgctaatggtaacaacttaaggaggtctctaatggctcttatttcacaatccgtcaagaacctgaagggcggtatcagtcaacagcctaacatcttaaggttccccgaacagggttccgaacagattaacggctggtcttcggagactgagggtcttcagaagcgtccaccttttgtcttcactaagaccattggagaccagaatgcccttggtgcaaaacccctcattcacttaatcaaccgtgatagtgtagaacagtattacgttgtgttcaccggacaggcagtccgagtgttcgacctcaatggcaaagagtacaccgtgaagggtgacttgagctacgtgaaggtagggaacccacgcgatgacctgcgaatggtgacggttgctgactatacgtttatcgtcaaccgcaacatggtagttcgtgccgataagacacctctctacactctgaaagagaatggagactgtctgattaacgtccgtggtggacagtatgggagaacgcttgcattcacaataaacaacgtccgtattgagtacaagattgcacaaggtgacaagcctgaacatgtgcaagagacagatgcgcagtggctcgttaagaaactggcaggtcttgctcgtgctcacggttccttcaaggactggaagttcaacgaggggtctggcttcatacacgtaatcgctccgggcaacagtcagattaaccagttgtccaccgaggatggctatgctaaccagttgatgaacgctgtgatgcacacaagccagtcattcagtaagttgccaatcgaggctcctaatgggtacactgtgaagattgttggtgacacctctaagacttccgatatgttctatgtccaatatgacaacgtgaagaaagtttggaaggaagtcgccgggtggggggttgagaagggtctcaatggtgccactatgccacacgccttggtccgtcagtcagacggctcattcgctatgcaggttctaccgtgggcacagcgctcgtgtggggacatggacactaacccgactccttctatagttgaccagaagattaacgatgtgttcttcttccgtaaccgcttagggttcctcgctggtgagaacattgtgatgtctcgtacctccaagtatttctcactgttccctgcgtcagtggctaacctgtcagatgatgacccgattgatgtggctgtatcccacaaccgtatctcaatcctgaagtatgccgtaccgttctccgaagagttgctgctatggtctgaccaagcacagttcgtcctgtctgcctctggcatcctctcaccgaagtctgtagagttgaaccttacgactgagttcgatgtgtccgaccgcgcacgtccttatggtgttggtcgtggtgtgtactttgcgtcacctcgtgcctcttatacatcactgaaccgctactatgctgtacaggacgtaagttccgttaagtctgctgaggatatgagtgctcacgttccaagctatatccccaacggtgtgttctccattcgtggttctggtactgagaactttatctctgtgctctctgcgaacgcccctagtaaaatcttcctgtacaaattcctgtacctaaacgaagagattgcacaacaggcgtggtcacattgggaacttggaagtaacgtaacggttctggcttgtgactctattggctcaactatgtaccttgtgttgcgcaatcagtcacacacttggatgtgccgagcacacttcacgaagaacagcattgacttcgatagcgagccttaccgcttgtatattgacaacaagataaagtatgtgattcctaaaggtgcctacaacgatgacacttacacgaccactatcaagcctgtggacatctacgggatgaagtattggaagggtaagttctacatcgtagcctctgacggtctggtatcgtggttcgagccacctcgtggtggatggcctaatggtgtccctgtgttgtcaatgagtgggaaccgagagggtgagactatttacattgggttggctatagacttccgttatgtgttctctaagttcctcattaagaagaccgccgatgatggttcaacagctaccgaggatattgggcgcttgcagcttcgccgtgcgtgggtcaactatgaggactccggtgcattcactgtggaggttgagaacacctctcgactcttcagctacgacatggctggtgctcgcttgggttccaatgctctacgtgctggtggacttaatgttggtactggtcagttcagattcccggttgctggcaacgcgcagttgaacgaagtaaggattatctctgaccacactacaccgctcaacgtgattggttgtggatgggaaggtaactacctacgacgctcttctggtatctaaccgtaaacaccccgactcaataagtgaacaatacgactcactattgggaagggggtttatacttaaaggagaaactctatgttaataatcagacctactaaagaaacagacttcgagagattcactccgtcacctgaagacatcgctgaggcacatgcctacgggattgaaccatcatttccaccagctaatgagtgtgtcactatgtcccttcatgggatgccagtggctataggtggcaattgtggcgaccaagtgtggttcgtaacgtccgctcgtgtttggaaactaagcgtgaagacccgaagagagttccgaaagctcattctggaatatcgtgataccatgctcaaacagtatccgattatctggaactacgtttgggttggcaacaagtcccacattaggttcttgaagtctattggtgcggtgttccataatgagtttactggtgacagtaatcaattccaactattcactataggaggttaactatgtgctggatggctgcaatcccaatcgccatgcaaggtgcgtctatggtaatgggcggtatgcagggtgaacaggcaaaggccgcacagattgaccaaggtcgtcgacaaagctggcagatgattaaggagatgaattacaacgatgctaaccttaagttagaatctcgtgacctcatcgactctactgtccaagagatgacccaagcgaatatgaaccgcgtgcgaaacatggggactatccgtgcggcaatcggtgaagggatgcttgaaggtaactcaatggaacgtgtagctcgcgttactgagggtgacttccttcgagagtctcaaggtctcaccgagaactaccaacgtgactacagtgtcatcttagggaagcgtttagctaaccgtgagaacacagtaagtcaaatcaatgaaatcaacaagtccgaaccacgtctgaaaggcaagctggaacaaatcattgacccattaggcttaggcttaacgaagctggtcgatgtggcaactgctggtagccctctgactaacaagctgggtaagaaggcagcttccaaggttaaggcttcagatgctaagtctaccggacaaggcaggtaaacacaggaggtaactgtatgagtaagttagcacaagcattaggtaacatgggtgctcctgctgcaagccgactccgtggtactggtcgtatggatgttaaggctgcgactgtctatgaagaccctagctatgccaataagtctgcactgattgggactgtaggtaaacttgctgagatgggcgctgatgcgtacatgaagtatgaccagaagcagaaggacaaggccgatgagcgctccaacgagattattcgcaagttgactcctgagcaacgccgtgaggccattaagaatggaacacttctgtatcaggatgacccttacgcgatggaagccttgaagattaagactggtcgtaatgcagcctacttggttgacgatgaggttgcacagaaggttaagaatggtgagttccgtactcgtcaagagttggaagagttccgtcacagccgactacaagaagccgctaagaactatgcggaacagttcggtatcaacgagtccgatgagttttatcagaagggtttcaactccgacatcactgaacgtaacatcgccctctatggcgctcatgataacttcctgagtgaccaagctaagaagggtgctgtcatcaacagtcgtgtcgaactgaactctgtactcaacgaccctgagaccctgcgttccccttatgctggtgagttctttgagaactacttcacggctggcttgaccactggaagtatccctagtgatgaccaagcgttcacaatgattagccaaggtctttctgatgtggttaaccgtgaaggtggtggtcagttcctgcaacagattgagaaccgtaaggtgaaactccacggaaaagagacaaccttcaaggaactgatgggtgccgaacagtggaacaatctgatggttaaggctcaacataacgagttccagttgaatgctaagaagaccgaggcattccaacttaatgtgaactctgcgttgaaccaagagaacgtgaacactggctgggaacaactgcaatccatcaaggctgaactggacacactgcaaccgggcgaagagatgacacctgaacgtcaggcgttaatcaatgcacagacgcagatgcaggacaggatgaagcgggagactgctgagttagcaaagcagatggacaagcaacagaagtcgatgaacaagatgaacgtcattgacgcacagttccagaagcgactcaatggtcagtatgtgtctactgcgtatggcgatatgcctaccaacgagaacactggtgagttcacccatagtgatatggtcaactatgctaacaagaagctggctgacatcgacgctatgggtattcctgatgcacagaaggaccgcatgaagctagactacctcaaggctgactccgagaagggtgctttccgtactgcggtaggtgaactgattggtgacgctgagaaggaatggacgtccgctgtgattaacgggaagatgcctgaagatggcggtgtggctcttaacgctcttcgtcgtgttcgtaatgctgaccctgagttatttgctgcgctgtatcctgataaagccgagatgttcctcacgatggacatgatggacaaccaagggattgacccgcagattctcttagatgcagacaaggctcgacaatctctgaccaaggatatgcagtatgaggatgacaaggcatgggctgctcttaagaacaactcacagtctcctgaattatcccgtatgccagccaccttggacgctggtgctcgtaagatttatgactctgtgaagtaccgtactggcaatgctgatatggcgatgcaacaggtcgataagtacctcaaagagaacacaacgactctcactggtgatgatgttgatggtgataccattggtgtcttaacgagaaactctctacgtgtgaccgatgacccggactcttggaaacagggtaaggacatcatcgaccaagctgcgaagaaactcgctgagactaacccttgggtgactaacaagcaactcactgtgttcgagcgtggtgactctatctacctgatggatacgacaggacaggttaacgtaagatatgacaagcagttgctctctaagatgtaccaagagaatcaagctaagttggatgctgctgcccgtgacaaggcacttaaagatgccaacaagcgaaccctacatacacgagctatgaaccgcaagcgtgaacgtgaagctaagaagcctaaacgctctggcagcatgtacgatagcgtaagtggcaaaggtattctggatacgctgactggtaaagactaacagaccacgataggaggttccaagtggataagtataacccgaacgaaccgcatgaatatgatgcgttatttcaacaagctgctgacacacatggagtctcctatggccttcttcggaaggtcggttgggtagagtcccgctttaaacctacggctcaatcaccaacagggccgcgaggtgtcatgcagttcactaaggcaactggtcaggcttatggtctccagaacgatgaggacttcactgacccggctaagtccattgatgcaggtgctcgttaccttgcagacctcgttaagaagtacgatggcgatgaacttaaagctgccctagcgtacaaccaaggtgaaggacgcaatggtaagccacaactggaagcctacgattctggcaactttgccaacattggggatgaaggtcgtaactatctgcgttcacttctggatgtcgctaagtcacctaagagtggggacattgagtcattcggtggtatcaccccaaaggctaaagggattccgtttgatgctgcgatgagtggtatcgggaagaaaggaaaggtaacaactgaactccctgagtctcactcaatgtcctttcaaggtaaagaacaggccgctcccaatcagccgttcggtaaagactattgggaagccaaaggaactacactcgacgaagctaacgagcgttcaaccttcttcggattcggcaatgctactgaagcagaactctccaactcaacattgggtgtggccttccgtgctggtaagcgtgataatggtttcgatgttgttactgacgtacttcaaccgacacggtttaatagccacatttggtcgcctgaagaactcgaaaagattcgcaacgaagtgaagaaccctgcgtacatgaacgtagtgctgggaggttcctctgagaatctggatgaactcatcaagttagccaatgagaacttcgagttggacgctaaggctgctgatgctggtcttggtgccaaactgtctgctggccttattggtgctggtgttgacccgttgacctacgttcctatcgctgggactgcggctaaaggattcaagctggttaacaaggcgttgattgtgggtgctcaagcgggtgctcttaacgtggcctctgagggactccgcacatcggttgctggtggtgatgctcactatgctgaagctgcccttgctggtatgctgttcgctggaggccttaccgctattgctgatggcgtggctgctggtctccgtaagtccggtgctgaacagattgagaacccctttgctgctgcacagatgcgctttgaggctcgtgagactgcacgtaacacaggtggatatgacgcaagccgtatgcctcctagtgaagaccgagtgttctcacagcacaacggcgttgagtatgcacctcttgaaactgaaccgggtgccgtagtgttgcgtgatggttccattatcagtgacaccaacttggctaacccgatgacagccaaagagttcgcagaagtagaccctgaacgtgctgcgtggggcttgcctatgcgtggactgagtgaaatcggcttgaggactttacgttctgaacatgctgaaatccgtggtctcgctaaggacttagtgcgttcacctacagggatggagtctggctcacatggtaagttcggtgctactgcctctgacattaaagagcgtctgcacagtacgaaccaacgaacctacaacgacctctatagtgcaatgaaggaagctatggctgaccctgagtggtctgtgggtatgttcaagcagggtgctcaaggtgctcgtcaggaaatctatcgtcgtgctgcaatcgctattgagcgtccagaacttcaggccaacttaacgaaggctgagcgtaaggtaatggacatcatgaaggaacatttcgacctcaagcgtgagatgatggagaacccgtctatgttcggtaacaaggcaacttctatcttccccaatagtcgtcacaaagggacttacgttcctcatgtgtactcgcgggaagccaagcagttgtactcacagtctcttggcggtactgacggtttacaggaagctatcgctgcaagctggatgacctcttaccgttcacgtcctgaagttaaggctcgtgtggatgagcacttagcggagaccttgggtatcgacccaaaggctgttaccgaagagatggtgatgaaacatgccagcgataaggcttatggtattgcgaagactgatgagttcaactcttcaagtgtcatcgacgataacattgagggtctcgtggggattgagaacaactcgttccttgaagcccgtaacctattcgactctgacatgccagttaccttaccgaatggacagccgttctctgtgaatgacctccgtgacttcgatatgaagcgtgtgatgccagcctatgaccgacgtgttgatggtgacattgcaatcatgggtggaacagggaggacaactgctgaactgaaagattccattatggctctcgataagaagtcagaagggaagggtacgatgaaaggtgaagtagaggcactgaaagataccgttaagattctcactggtcgtgctcgtcgcaatcaggataccgtaggtgacactatggttcgcgctctgtccgatatgtcattctttacgaagaacgcatacatgggcttgcagaacctaactgaaatctctggtctcttagcaaagggtaacactcgtgcgatgctgcatggtattcctgctctgcgtgacttagcgttccgcaacaagccagtctctggtaaggaactcaaggaactccactcaatggtgtttggtaaagagttcgacgacctgattcgtccgactcgtcaagacatcgttcagcgactacgcgagtcaaccgatactccagatatggctgctaaggctgtagggactatcaagcacacgactcaagagttagctgctcgctccccgctcaccaagttcctgaatggtacgtcaaactacattctcgatatggctcgacagggtgtgatgggagatgtggtcactcatgctatcactggcaaaggtgccaacaagtggattaagaaggacatgctgaagtccgcgagtatctctaaggaacagtgggaaggcattcagaacctcattcgcgagaacgtcactcaaggtgctgacggtaagtacaccttcaaggacaaacgcaagctggctaacgaccctcgtgctatggacttgtggcgtttagctgataaggttgccgatgagacaatgctgagacctcataaggtttcacttcaggatgctcatgcctatggtgctgctgccaagctggtgctccagttcaagtcctttgtcatcaagtcgatgaacgctaagtttatccgctctggtcacgaggctatgaagaaccaccgagctatggacatggcgttaacctatgcaatctctggtggcatcgctggtgcttactatgttgcacaggcacacatgaaggctgctggtctaccgaaagagcaacagaaggattacttgaagaaagctctcgaccctaagatgattgcgtatgctgctgcatcccgtagttcacacttaggttccccgttgagcatcgccaacttcgctatgggtgctgctggttacgaccaaggtctaatggttcgctctacgattctaccgaaaggagaagacaagcgtgaccggaacaaagcagtgacctctcgtgatatgggcgattccatcatgggcgctattggtgaacagattcctgctcttggtttcgctggggcaactcttgctgctggtcgaaatgcttatggtgtcctaacggctcctaacaaagtgaccgagcgtgagatgatgactggcttgatgaacgctcatcgtgagatggttcctaacgaccctatcactcaacagatgctcattaagttctatgaggctaatggtgttcaccttaaggctgacaagaagtaatcaatacgactcactaatgggaaggctcacacagcttccctctatccaacacattcgaaaggaggctacagatggctaacaagattcgtactgtgatgacttacccgctgaatggtgccgtgaacttcacgattacctttgattatctggcacgtaagttcatccaagtgacacttattggtaaagaccgtaaagaactggttctcaatcaggactatcgttttaccagtaagactcaaattaccactactcgtgcgtggactgccgctgatggctaccagatgattgagattcgtcgattcacttcggctactgaccgtctggttgactttgctgatggctcaatcctccgtgcatatgacctgaacatctcgcagattcaaacactacatgttgctgaagaagcacgagacctcactgcggataccattggtgtcaacaatgatgggcacttagatgctcgtggtcgtaagattgttaacttggcgtatgccacaagtgactatgatgccgttcctttaaagcaggttaaagagcgtgaatcctctgcatggaatgctgtgacaaaagctaacgaacatgctgacagggccaataaggaagcaaaccgttctcgtgatgaggccaaccgtgctcaacgtgaagctgaccgctcaacgcagcaggcaggcgtctctgcgcaacaagcagttgagtccaagaagcaagctgaccgttccaactctgaggctaaccgagctaaaggttatgctgacaatatgaccgcaagtgtcgctgaggccaagaagcaagctgaccgttctaactctgaggccaatcgtgcccgtgatgaggccaatcgtgctgccggagaagtgactaaagctgctgctgaggttgccaaggctgctgcacatgttgagaccgctaagggccatgctgaccgagccaacactgaggcaaaccgctccaaaggtgaggctgaccgtgctaagtctgaggccgacaagttgggtaatatgaatgacctagcgggaaccattgagagcattgggagtaacggcaaggatatcaacttcaagggtggcgtgaatggtcacacacttctagctaaagattctgtacatgccgggacacaaccaaacactgcgttctttaatgataacacactacgtcttcgcaaccgtgaccacaaggaacgtgcttgggacatctttgtttggggtaatgattctggacggggcaacgtactggagttcggaactaactacggtaaagggtatgggatgtacgtgcaatttgctaaaaatgactcacaagattcccatcttcaggttaacggctcgattgcagctaagacagatatttcaggaaggggcatcacagcaagtggggaattgattacccgctcacaaaaccttaagctgattaactctgctcgtcgccatattcagttcatgactgccgataactacactgatggttatctctataaagaccccggtgctggtgtgtggagacttaactttggtcaggcagctaacatggagtatacgtttgcttcaaacggtagcttaacatctaactccgggtggaacatcccaccagatggtaacttatacatcaagaagtataatacatacattgatgcgtgggtgaacaagcgcctaagcgaacatgcctacaataagagcgagacaaacaacctagtgaatggtcgattgacacaagcccaagctgatggacgctacatccgcaagaatgctgggtgggctgaagtgtggaaaggaagtgctggaggcggtgtctcggtaggtctctctcaagatgtccgctggagaaccatctggattcaaacacaaggtcgttggaaccctgttcaaattggggataatgggtcttactatatctcgtctaatggtgggtggttgcagttcaccatctctaataacggtaggacgttccgtaacgatgcagacagggcttctgttcctaagagaatcttgattcaaaaccaataatggaatataacgaggccaaggatggctgacattaggaggacataatgttgtcattggattttaacaacgaggtagtgaaggctgctccgattgtagggacaggggttgccgatggtgctgccagactgttcttcggactgtctcttaacgagtggttctatgtagccgcaattgcctacacagtggctcaaattggtgccaaggtagtcgatgtgattatcaaatggaagaaggagggtaaaggtgtataaggtcggttatgggggaggtatccaaatggatgaacacccggatttcattaacggagaggagaattgggatgtctgataaaagtttaattcaattccttgagatgctggacactgagatggctcaacgtatgcttgctgacttgcagaacgatgaacgacgcacacctcaactgtacaacgcaatcgggaaactattagagcgccacaagttccaagtctccaagttacagccagaccgtaacatccttggtggactggcagatggactcgaagagtaccagaacttggtaggctccgatggtctgactgaagacgagaagtacacgctgaactgatggtaatactcaaggccactagatgtagtggtctttatgaattatcaacacaactcacggtgactctacgtgaaatctgagaaatggggagggtagttatgctcaagaatttaaagagctacgccatcgctgtggcctttgccttggggatgacccttgcgtacaaccacggctatgacaaggctaacactaaatgggaacaggaggtgcacaatgagtacgttaagaaagttgaggcgactgcggataaacaggctgctctcaatgaagtctcacgacaataccaagaagaccttgcggcgctggaaggcagcactgatagggtcattaatgatttgcgtaacgatggtaagcggctgcgtgtcaaactatcagccacctcacgagaactccaagctaacggtggatgcctcgttgatggtcgagccgaacttgacgaagagtttagtaagcgtcttatcggagtaacacaaagaggggatgcgtggattagagcgctccaaggtacaataactgaaatgcaacgtaaggagaaataacatggctactgtaaactcaagaacccgtaccatctggactatcaatggtcgctcaccggacagccgggatatgtacgaccgaaacaatgtgggccttcgtgttgggcgtatcgacatcccagcttcagaaatggtcaaggtagatggctatgacaaggttgaatatgttgttcaactgagtgacggcacaaccgagcaacatgctacctttgagaccctgatgtccacttggggtagctccgtcgagtctaaaccgggtagtgggttcatgactgtatttctgaatgatcaaaacactgagcgtctcggtatggttcgaatcgacgtatacaaagagtggactggtgttgaccctgaaccggaaggtggtgtggcttcattagttagtgcaacgctttctgcgtctgatagtgcatttggtacacagttcgtggacagcgaaggaaagagcgcttccgttatgttccagcctagtaacatcgacggggctgtatctaagacagacaccatcaaggctctggagaagcgtatcgctgccttagagaaatctgccgagtaacaataggaggccacaatgtcccaagaagctaagaacgcgctaatcattgcgcaacttaagggtgacttcgtggccttcctgttcgtcttatggaaggctttgaacttacctaaaccaaccaagtgtcagattgatatggcacgtacactcgctaatggagaccacaagaagtttatccttcaggcgttccgtggtattggcaagtcctttatcacctgtgcgttcgttgtgtgggtcttatggcgtgaccctcaacttaaggtgctcattgtgtctgcctctaaggaacgtgcggatgctaactccatcttcattaagaacatcattgacctgctaccattcctcgctgagttgaaacctcgaccgggacagcgtgactctgtgattagcttcgacgttggcttggcgaaacccgaccactcaccttctgtgaagtctgtaggtattactggtcagttgactggtagccgtgctgacatcattatcgcagatgacgttgaggttcccgggaacagttctacaagttctgctcgtgagaagctgtggacactggtaactgagtttgctgcgttgcttaagccactgcctacctctcgtgttatataccttgggacaccccaaaccgagatgacgctctataaggaactagaagataacaaagggtacagcacagtaatctggccagcacagtatcctcgtaatgaggctgaggctctctactatggagaccgcttggctccgatgcttaaggttgagtatgatgagggctacgagattcttcgtggacaacctactgaccctgttcgattcgatatggatgacctccgtgaacgtgaactcgaatatggcaaagctggctacactcttcagttcatgcttaacccgaacctgtccgatgccgagaagtacccgctgaggctccgtgatgccattgtgtgcgcagtggacactgaacgtgccccattgtcctaccagtggttgccgaaccgtcagaaccgcaatgaggaacttcctaacgtgggtctgaagggtgacgacattcacagcttccatgtgtgttcctctaagaccgctgagtaccagcaaaagattctcgtcattgacccctctggtcgtggtaaggatgaaacaggttacgcagtcctctacaccctgaacggctacatctacttgatggaagtcggtgggttccgtggtggctacgatgaccctaccctagagaagctcgctaagaaggccaagcagtggaaggtacagacggtcgtacacgagagtaacttcggtgatggtatgttcggtaaggtattctctccggttctcctgaagcaccacaagtgtgccttagaagagattcgtgctcgtggcatgaaggagatgcgtatctgcgacactatcgaaccgttgatgggtgcgcaccgccttatcatccgtgacgaagtaatccgtgaggactaccagaccgctcgtgaccttgatgggaaacatgatgttcgctacagtgcgttctatcagatgacccgtatgactcgtgagaagggcgctgtggcacacgatgaccgacttgatgctatcgcattgggtatcgagttccttcgtgaagggatgcaggtggactctaaggtaggtgaggaagctatgacccttgagttccttgaacaccacatggagaaacctatcatcggtggtgacatggctcgtgagttagtgtctggaggtgtggacatctactatgaggacgatggcgatggagagtgcttcattgagtggtaatagataagtatgcgggaaaggtgcataggtaagcacttagtaccgctacgttaccattgagtaacttactgatatacatgaagaaattaatacgactcactattgggaagggcaccctaagacaacttaaagacacttatagactgcatatgcaaagtgcatacttagtgactactcttagagacccttacagtgagggatggtagtaatagtaattacatccccactatcagtgtaaccatcaagtataacaaggaggacgctctatgcgcttactatccgtgctcaagacactggcaacgcatcgagtgacctacaaatttctcgctgtacttgctgcttccattggtctcgcatctagtgctgaacacatcggtgaactggagactctgctttgttctctactcacttgtgtttcttagactgctcattggcgcttagtgcgctcttagtgataatggtcgatatacatcttccctattatcactgtaagaagtcaactctaagagtaacccttatgtaccctctatggtctacagggtctcttagggtctctcacgtagtctcaccgctatgctcctgcgtagcaccttatgatagagcctctgtggtgaaccttatgagacttgatgtaccccttaagaatcctacagaaaaatctgagtgggtatctcatagttcatacaaagtgtttcccccctatggcctccttcagttaccccaaagagtcggcccctatggtaactttatgtttacttaatgtcaatccttatgtgtgacattgggatgactctaggtgttaccactagatatagtgcttagtgtgacttagtgatactatatgtagtcctctatgtgtccctatctgtaagtgacctttgagtcatcaccttatgtttcctctttgagttaacacctta

SEQ ID NO: 6 - DNA, 44863 bp, artificial sequence
  BP954
tagcccacccacgctcaccctgtcaaacgctcaggaatggccctaaaacgccctgtgtaagccctaagcggttgcactaaggcaatcaccttgtccaatactaaggcgtgccctagcgcttcctaggcgttctccttgtgcagccactaagagcagacctcggcaagtcctaggccacccgtcgaagacggaccagcccagcccaattcccaagccaaccgcagcgcggccccatatgggggaaatccggcgagggcgagggcgagacacctcacacacgcctatatcaaaattttgactttggttactttgtgagcgacctccgtatcttctcgtcccttatttggtcttcactaagaatgtacctcttacgacctaggacatcactgagtatacacaacaaagataacatacctacaccctcctttgatggcactaagagcaaacctaggtctgcccttgtgtacactaagatattaacctgcttaagcagaagatgcagaaggtttcttcaaggcacgacgttgtacatccttggcaatggcgtatgcctgcttagggtcacgtcctgattgaataagttcttctgcgttctggcgtacagcagcttgcttaactgattttattagcggcgtacatctcctctaatttatcaagacgatggcgagtgtaggcagcctctaggattagaacttcactatatctcacaccgtacctaccttcttcgaaggacacaattccatacttaatggcatccaatccttcagcttcaaaagcagctacaatatcctgagccaagacaccgaagtgtatgctatcaagattcctctctgcttcactattcaaaccatactgtttaaaaccaactctactccaagcctttaacaccttggtattaatactagagataccgtacttgtgttcagcatctgaagttgtaacagggtcactacctaggtatatggtagtgaatcggttactaggtccaccagcagcaaactggttatctacagcaggcatgattggtgcaccttggaataggtgctcatttccgttataagtgatacgattagcattacttgaattagagccgtgcaaagttatctgtgcacctgaagaggacgaagtcttttctccaccacaaataatcaaacgttgaccagttgggttatcctttggaacagacttgccaataaagccatattcaccttccatctgcgcttcagatcgtatattggaacttgtgcttgctttaattgttaagtgtccaactttagtatcctctgtaacaatgttatctgagaaatacaaaggtgcagggatatttcgtaccccatcagtacccatgaaagtaggtatagcttgaccaggagttgcaccatatgtaaacttacgagatacacgattgtcatttgcaatctgcatcttatagcagtatatatcagtagggtgcccatgacctttaaatgggtctttatttttgttgtcaccataagtcattgggttgaaatggttttcaccaccaaagatatagtaaatgtagctgtctttaactacaacagaacctacacctacactagagttcacaatgtccccttgatagatttggtctgtgatgttaacccattcaatatcatctgcattccaattgtttacattcaatcgtgcatagaaggtacgaggataagatgccctgtaacggtcatctggtgcacctgcttcccattcattttctgcacgttctgaaccaaacataataaggtcatctcctactttagcaaaaggtaaggtagtatgatgaacattatgtggaaatctcagtgactcccaagtctgacctatatctctactacgatgcaaagagcttccaagtctgtcaccacgagtgccacgagtgataaggtataatacaccgtcatagtacttgatgcatggctctgacgcatctggttcatactcagatggtatctgacgacgaacataattagatgggctattgaaagcatcagggaagtagaaaagaccaacttctcgtggagctacatcaccttgatgatatcccataacaaagccattgttatcaatagtagcaaagctatgcacctctgtgacactagggattagaccaagatctgtcttacgccatggagacttatggaaagaagtacccatgtgccaactctttccagcgttattcaaatctgaagtctgctggttaggtgtaagaaccgtgaagttgtccttatctattaccgttgcaacagtcatatcacctgatacacctgttaccgcagaattagagaagttaacaaaatcgcccacgaataatccgtgatctggtacatgtattgttgcatattgctgatttgcagccttagtgataccacccgtaaggtgcagactacgagacataggacgatcccacaatgcacaattggttagagcgttattggctaaagtacgtgtttcaatcatggcaaacagacggttgcgacatacacccatgctcatacaatgatagttcactgtagggtaatctggatgcagatcagttaaccactctggagtagaccatgtttgaccatcgtcaccagacttaacccatgatacatgcagacgactaacaccatgacggtcactacccatgtaaggtgcatatatcacgttctcatatacaaacgctttgtcttgaggccaagcattgtaataagggttatccgtgattttatatagttcaccattgataaaacctttactcacatagtaaagaggttgacctgctaaacgttcccatacgaagcgggtgttatagaatcgctccatatcaggtaaagatgatactttgtaagtagcaccagcaccgtcaattctcttacctgaagccatcgctgcatttactgcatcttggtcgtttgtcttaccatcacctttggctccaaaatctttaagcgatacaacctcggtgagcttgtcatccaagttacgccagattgcacctgctattttactcttgaatttaactaatgaagaacctagtctttgaatcatgtaacctccttttctgaaaggctaccatcatgataacctttaagaaaagttgcgcgaaaagcagtgcttacgcactgcctgtgattacctacgaattgcctgtacgtgcaatattccgttaagtgtaacactactacctgcacttaggtttttaatgtaaacattacaactattatcaccttgtggcttcagaataatagcacatgattgaacatcgaaagtagaaccatatgtaagaacatcacctttatttggtttatagtcaccaactaattgtatagttcctgcatttaaatctgcattaggttctaatgttgtgtttacaactagtgtccctttagctacaacaccattattactgcaccaacctacagtaagtgatgggttaaatacggtattgtcatattcaatgagactatcttcaacagcagccatagatgcaccacccttagcaccgacccatgccttaagtgctgtagttcctagcttaattctagactcaccagaggccataattgggtaggtgaagatactagtagatttaaggttctcaccgaagaagattccatctacattgaccctagagctgtcgtgcgctctaagaaagtatgcttcttcacttccagatgctggatcaacaacgacattatgcgagtgtaaggcataaccgttgattgttactgtagaatctccatgaataaatatagaagcattaccgctatgatggatctcacaattctcactatacatgccatttatcacaagacctttgcagtttgtaatatcaaatgcctgtaaaccttggatatcattacatccatccatggcgcagttattcattgtcatattataaacattagccagtctatatgcttgatagcaattaagcgcatagcatgtatccataaggactgtagttccagtgaacttacggaacccctcccagcaattgatagcaaccacattgcgcattgagtattggaatgctcttgtttcatcatgcaaaccaaagtatgcaccacggacaatgatgttctcaatgataaattgagaaggccatgcttgttggtcggcatcacctagatctatgccttttctgcctgcatagttatctggtttgttctctccataatctatgaagaacccacctaaataaccacccatagagtaacctgcacttacatcatatttcaatgcaggctcactgtgtgagattgcaaggattgtaccaagactcggaataggtgctattccgcctccttttataacctgattcttaaaatacaaagtctcactaattatataaatacctacagggatatatacattcttaccagaagcaagtgcagctttgaatgcagcagtatcatcagcagagccatcacccttagcgccaaagtctttaacactaacaaagtagttatcagcgtgtaaggtgttatcccatgcttgttttagataatctgatagcagccttccttcatgtataataccagttgtgacaggtttggtaatattagccattaaacctcctattacttcccaaccctccctatgaagattggctagtaataggccgttcaaatgaacggcactcttcctccttctatagtgtccagtaaatagtaagacactgatacataaagttatgtattaattatatccgcgttctagcgaaagaatgtacagaccaagttttgtagcgtcaggcttactgaaacagaccttatcgtccacctcgtaaactgccgtcagcgtcggccccagaggtttcaccattgctttctctggtaacgcctgctgacacccggaagtggtcagcgaaccaatcagcaggattgtcgctagcatgattcgcttcactttgtgcctccttctcttcttgtttcttcttagcagagacaagcaggccaataagacctgccagcacttctaggaacttattcacaggtaatcacttggcagaccacatctgtcacagaggattccgtgccagagccaaggtctacaccaagacctacagaaacaagagcaataacaagtgcaaccagtgcacctacaaccttcttagacttaaacagctttttcattgcatctccctttccattgagctaacaagtcagagtagttcttccagtcatcatagttgccatcctcggcagcttgggtaaccatacgctcacaccattcaacacatcttaccatcgcgcacaaccatcccgtacatcgatgtgagtaaaggagttatacttaccgataccatacttgccttggtatttgctagtaagatacttatgcacttcagaaggtaatatgccagacactttaatgtcagcagccttaccagtaagatgcatggagttcttagctcctcctacattagcattgtgcttagcacagcgatgccccgaagtgataactacaggagaaccaaagtgctcacgcacatctgtgactacctgcagtaattcagcatcaacagtggatgtaccgcacccacaacggcaagcgaactctttacgcttgaagtatttgttaagcattattaatccccttctggagtgacaggtgtcacctccatagtagttgcatcccacttgtcagttggtgcagagccacgcgcaatagcaatataaaggctatctcctttatctacaaccaccatagcacctttttgcttaccagataggtgttcaatattaattggatgatctttctttttaaggtcagcttctgccacgataggcataggaattgcagttgcaatagtttgtactgcttttacacgaaaaacctgaccagtagtcgtacctgcatcgccatacttagacatattatcttctccttttattaagccggtgtaataagaccaacgctgtccattttaacagacaaccaatctgcatcctctttgctaccagtagcaatggcaatctcaagagtgccacctacaggacgacataccattgctgctttctgtttaccagatttggttgcatcattgataacattggctttcttcgtaatagactcctctgtaacaacagggagcattaatgcctcactggtcggtgtaatctgcttacggtcatatcgaccagttaaaggttgatcactataatcattagccatctaatactccttatacatataagtaaatagtaagtaggaatagggtgtacaggagtacacccacactatagtaacctatataacctaggttaactatattatccttgttatttctcttattatctgggccttccttctatagtgtccagtaattaataagtccttgaaatccttgcagaaagtgtatttctgcttgccgatttatttcggtagttctgcccgtaaactcgctgctgcatcgctacggaagtgttggtcactcttcgctcagtaccgtaatctccatatagcattgccctgcgtagatgaggtgtattcatagcatggatgtaatcgcgcatctcctgcgctctgaggcgattaatccgtgtaacctcgtcatagtctatctgagaagttaattgccgtatagcgccatacagggcgtctaggcggtcatcgtgccggaggctgttcttctcaatcgttatgttcgacatttgattgaaaagactgtaggacatgcgtagttcaagcggatagtgctgtaccgactcaaagtctgacttcaccacctctgcattgaagataagcctatgggctgccatgagcggctccagcgtctcaatgatacgcaactctttctgtccggtggcgtaatcctcttccagagttacaggccactctcgttcaaagtacggcttaattaccgcctcaaacgcgccatgaccaaagttcttctcaatgaatacctctttaacacccgcctgctttgcggcctgcacaatgcgattcagggacgactctcggtatccgccaggtacaccaaagcactgatacacataaatgaatgtgccgtgcaggaatacgatggctacacccgtctcatctccgttcttaccaccacccgcagggtcaatatacataatcttgcgggagacagcaccccattcgtatgggcgagctacaggtctgtacatgaaatccgtaggcttgttaccatacttaggtgcatcaccaatgatgtttatggaatcattactccacgtaggcatcacagggacttcctctgtaccaaacgaggtgaagattagattgttcaggcgtaatgggtatctgtcagcatccatcatgcgagtgttaagcataaactgaagctggaacttagcagcaccctgagagatttccttctcaatcaggacttcatcatcatacatttcaggggcacaaggtgcaccactattaccatccaacccgtaccctgagcgaagtgctgggttgtccttcatatcttgaacaatcataggtgcaaggaagtcgccataacattgctcttgctctactgaagggtaacgcgcagtccagatacgaacagagtaaccacgagcaggtaggttgttgtagatagagtttacgttctgaggtgtaccaaggtaaatgatatccccaaactggttgatagattcaaactccttagtcagttcctcaagcaaggcacggcctgctgccgtacgagcattctgcatcgactctacgtcatccgctagaataatatcagcacgagcaccctgcatacctgcttcgattgagtaacaggatacagaaggggacttatcactaccacgtagggtgtaatgaatctcaaacgccttaacggatgcacggtccccagcgtagatatccggcagcataaactcaagaaagtctaagccacggaagattttaactacccaacctgcgatttcctctgctcgcttggcgttttgggacacaaccatgatacgcttatgcggttcatgaataatacggaataccgtatagattgctgatagtgttgtcttagcgataccacgaggcgcttcgatgaggcggtacttgtgtccgtaaaataggaacttcaagatatccgcctgcatacgaatcagatgagggttgcctgcaattaagttatgaataactgtatctgcaaagagaagcaaaccttccgctgtgtaaggaaaggtctgctgtaactcctgtagcatctcccatctggcaagagcctccgcttgtgattctcttgccttagccatcaatcctccttagtgaattgaattatcttaccactggatgcctctcggatagccttgaggcgcttagataactttgactcttcctgctgtgcagcaggtgtggcggtaatgccgttatcaagaacccacttacacatcgcaccaatatccttaccagacactaaatgtaatgctgcatcagggtcttcttctatagtgtccagtattgcctgtgctttcttattgaagattttggtaatagcaccatgcagaatgccaacctcgtcctctgtagctgcatgtttattgtgtacgctcacgcttctccctccaaatcttgaacttattataaaaccagtccccaatttgcaacacggtataaatgaatgttgctattaacacccaattatcccaactgataccgaggaagtacccacctgatacgagtgcaggtggcgcaagcttcacaccactatctaccagttcggagttaatcatcccaccccccttatgctgtgataatcttagcagtcatccggcattctggtactctttctgagaaagtaacaatgtcaccgtctacctgataagcaagtttaggttgtaataatccatcaaggtagacctcaatgtacttaaatgcagagccaatctgtactacttgttggccttctactaagtcaaagttcaactctaactgaatattaggttcagatgtagccacacgactaccaatcagcacatacacctctgtacccgccacaagcggctctgcgaaagtgatagtgttgttgcttatagagtatgcgcctacaatttggtgctgcaataccccattaaggaaaactagtgcatcttgaaattcataaggtggttttacggaaatctcaccaccttgggctatcgtgtaccaaggaacagttctgtgcgcaataccagaagtcataccagccttaaggccagcaatctcaatgtcctgtttggtgttccaatctgtatgcttcttgtcgatggcatcaagctgccctttatttactgcatctccaggatttgtgccatcagccaaatcagtaatcttattgccgccccagcttacattctgtttaatgaagtatccttctggataaaacccgtcaagtaactcctgtgtaatctccagtatatgaatgaaagaaccatttaaagacttcatatccaaggtaacaccacggtcaaactcagcgtatggatactccttttgtacttcccttcgaatacggaacttcaaacctgcaactggtgctacatcaaaagtaatctggtgcgtgccagttagttgccagccagatgtaacctcaatccaagtgttaccttgaagagactccactatcacatctgaggcacgaagataacctttatccctaccagcaaagctaaagggataggttacttgcgtaccgttggctatatgttctgtgaaagtataactcattaatcctccagttcatctaagccataacgcaatgcgttctggattcctattacattagctagaggcactaagcgtaaagccctacgtgccacatctacaccttctgtatcaccctctgcgtatctagttatagaatctgctaaacgatatgcatcttgaccaacacctactagtggtatttggtctatcaaacccttagtctgaaagccagcctcataacgggattgtactaactcagaaggtagaacacctaggccacctaagaaatctccacctagactaaatacagcagttgtactcatcatacccattgcaccaaaggccaaccctttaggcgataacttctcttccaaatattcatcttggtcttctcgaccaatagagttcacataggcttttgccgcatacactattgaacccaaagcaaaaccgtaagctgtcttcttagcaagaccaattttatcgtggcgaatccctcgaccaaattgcttctcaccagatacaagagagaacgacttaagctgtgcaaatgtcttacctagtgctttgttcatccagataccttcatcaccaatgaagttacgttggataattagacctgacttacgacgaatagcattagctaaagtttcacccatggcataaggcattgtatcaaagccaagcaagccagaacctttagagttagcatcatagtgcttctgtaggttagtcatgaactcctgagtaagaccaagttcctccagtttcttctgaggaataatcttcttgccttcaaggtggtcaatgaaagacaaagctatttgcctattggtcattcgctccagagaaccctgtgccatgcggaagagggataggtttgtctgagcacgtcgtatagagttcatggactggtcaaaatgggccatcatacctcgcactgtggttacatcaccaaactcatctggacgcgcacccttagttgttagccagttgtcttcaccaatgtaacctaccattcgctcaacctcagctaaattcttatctcgaaagaagccatcgccattacgcaacgccttagaggtgaagcggaattgcttacctaaagccatagtggtggcagcaataccaaactcacccatgaagttagcaagttcacctagctgtgcgaagcccatctgacctaagcgaagtacgcctgtaatgtcacgcccacgacgcagcattttagtagacaaatcttgtgggtttgaatcgatagatttacccataatcaagcgaagcccctctcgcatctgacggatttcttcatcaatagccagacctgctgcttcatctttctctttcaatttaagtcgcttctttaactcttcaatcttctcttgtgccttcttgtaatcaggctctgattgacggatcttagccgactccgcttcaaattgtgcgtgtgcttttgtatctttagctgcatttcgtgcatttcgctctacaagatcaattgcattaagtgcagcctgataggtagagaaaccttgacgagccaaggcagcaccacctgccgcttccttcatgtagttatctgttaactcttccacgttagtgttcataaagtcacgcatacgaataccattgtactcttgagtaacatctaagcctaaactcatcttagctcggttagagatattatctctggtttctttattatccagagcttctaccatcttttcaatctcttcatcactaaagcctgctttgcgcatgagtgcttcatattctgctttggtttgaccagacatagccttttcaaagctaagctgtccggtcaaggtggcatcagcaacgcggtttacttgtgctcgtgcaatatcatcagccacttcctttggaaccttacgagaaccattctggtatgcacgagagaataactcaatgatgtcctctttatcgtgcatactgaattgacgacgagccttcatactgtcaaaaatatcaggcatgtacttatcatctgctttaaccttttcaaacccagcttcaccagagcgttgacgtaatgctaatgcttcacgatacatagcttgctgcccctctgctgccatacggatagacttaggcgtagactcatccataccgatgcgtacagcttcccataccttctcattatattgctgcacatagtgagagttagtatgacctgcaactggattgatattattttctttgagccataagtcaaacccgtcattgaaacggttcatatcagcagatttcagacggttcaagttagtattctgcatgagactagcagatgccttctgcatacctaagccttggggggactcaaacaggcgagcaccaaggccgcgtacacttgcatcctgagaggaatgtacgacagtaccaagggcagacagagttccggcccagcggcgaggggtcatatcaattgcattaccttcccgctgtagggttttcagcaaatcttcacctttgctagagacatcaaatgcaccctccgtgagtacctcttcacccttaacacgcatcgcaccgatactatcatcagcaacagcacgcacatagcggtcccctgcgtctgcactgcgcacaatgctcgcagccctgtcatccccttgctcactgagcttagtggccctaccacgcgctacagcgccaataacgccacccatcgccataccggaacctagtgctaccataatgtcatccaaatcacgagtcatgtcaccttggaccaatacggattcaatagcggcattactcacgccagcggcgatagcgccacgcacagcacggcctacgagcccaactttagcggcaccaccggttggaatagaggcaacccatcccacagggtcaagcacagcagcgccaatcgtcgccacagagccaacccagccagcctgagcaatgcgcttattgcgctcaaggtcttcatcagcattctgaatacggaagttcaattcatcctcagaacgaacaccctcagtgattgtctgcatcatatccgtaccatatttgaaacgtagtgcttcacgttgctcaggttgtatctcaaagtctagttgaggtgtgaaatcagcagtggcacggtcataccaccgcttgcctccgaatgccaaccactcattctggaaggcagcacctacagcacctaaaatatcagcgtcagctttagcttcaagaacttgctcttgtaactcattacgctggcgtatcgtaggagccgataccggagccgcctcaatagaaaacggctcaggagtagactggacatatccagcccaattcgtcttaatgtcttgttccataattcctccatagtgcctatcataaagacctgtctcacatgtgagacaagccttgagttaggtactacaacttaactttacctaccttagaacctttagctaactttgtaggtgcagcctcataaacctgataccaaccatccgcgccaatacgtttatgagtccatgccgagacagaacctgctggcataggtccaccaaacctaacccacatggagccatcttcacgagtctccacttcggtaatcttaggcacaccaccagcagatgccatattgtatgcctcagcgcgtcgcttcagtaggccaggaatacgcttaccttcacttgatgcagtgcccagcatttcgataaaaccctccgtaagcttaccagctttgaatgcagcaagagcacgcggtgagttctggattccacctttacctaaattgtaggttaaatccatcaagccacgttgctgtgcaggatgcatctggtcaaacggaatcttccagtcacgagtaggaggcacatgcttcttagcatcttgctccataagggcgcgagccttgctctctgtaagctgagacatagaccctcgatagggaactagttcatcgccaatcttaatatacccgtttcgcttctcttcttccgttaagaaatgaccgtaaccgatagattcaccgtgagcgtctttatatggagtaaaggttccagttgccttattaaagccaactttatctttattctcatccatagctagcttgtcatagaattgttgcatattacctcgatagttaatctcgaagttagaaggcagattctcaccagaagcaaaagcagaagacatgaggaagttagctagtccaaatttaccaatatctttggcagttggtttagctggcataggctcttgtgcaccaatatctgtacgatacgggtgaacatactcgcctttatctcgttcctctactttcttctgataggcagaatctagtagtgaagtagtatctaaagaggttacagggattactccagaaagagggcgacctgctgcaccagcacgaatcacaaaagttcctttctgttcattgtaatcaatgtatatatcatctttagtttcccactcttgaagctccttcttcaattctggcatctgtgtttctacatacctaccaagcgccagaggtacatcggtagggtttacgcctttcccaactgacataagcatatcagatgcagaagtgtaatcacctttaatgaaatagccaccggaagtctttgcatcctctgattgagtgtagcgtttattgccccaagtaattaaagccttcttgatggaatccatgttacgcataccactagaccacaacatattggccttagctcgtaactcttcttccgcaatagctttacctaagtctgacacttcggttttaccatcaaaccagccagcaccagacacctcatccagtgcctctccaatagctgagttgaacttcttggtttccttctcagtacgagagaatttctgctgtgcttcacgcgcaaaccttgcagcctgcaaaggtgtctctcccatttgtagtgcagtgttgtagttatccatgtagccattcaccgtgtcaccaaagacacctcggctctcttctggcaactgttcccacaactggcgaatagtcatcaactcttgtggttcgcccttggcaaagtgctcaggcgatagcatagattccatggctttgatacgagactcaaaggtatcatccactaagcctttggagttcatgaattgtaggcgctgcacttccactgcaccacgaatagcttcagcctcttgactgtaagggtccaagccacgttgtttgatttgctggtctgcataaagttggctatcttgtttgataacatcaatgtaagccttcttctctttatcagtcttaccttggaagccagtcaggcggtcggagtaaagctcacggcgcatatcctgcattgcacctagctctgcattctgcttagctcgttggcgcatcagtgcctctagttctgggttagagaagacagagttacctgtcagattattaatgtgctgtgctcgttccaacaattcttcatcagttaaatcgcctgcaaggtatgattctttaacttcgaaagacatacgagttacatcagctacattattcctagcccaaactgcattaccgctagtgatggctgtgataagctgtggattcttagcataaacagaaacacccttatcgtccttcacatacttcagggcttcagccatgctaacatcaccgccttgtgcaagtgaaattgctcgctggactaacttcttgtgcatctgttcaggtagtaatccttgagtaagaccttcgcggattcgttcctgtaaagcatatccagaggcttcaggttcaatattagaatcccaagtagaagccactcgcccgtcaaaggtatcctcacggtctgcttgttcacggtcaagtttatgctgggttcgtgtagcccaaatctgaggctgctgttcttggaagacattagtgaccatacgcatagtatctttgtcaccttgcaactcagggtattgctggaacagcttattctgcatctcattacgagagtcaaccataagctgtgtccactcgtcatccgttccttggaaacgagtagccatgtctttcattcgtgctgcttcatcattagctagcagttgagctttgacaagcatgttagcacgagcgccaccacgagttgcatcctcagaaggcattaatccgttatatgcccgttccatttgaacaaccttatcttcctcaatcttttgattaaggataccagtggttacatcagctacactactggctgctcgaataaggtcttcgataaatcgactaccggaggtagaagctacgccagcctccacacctccaactcgctgaggtgcaaaggtcatgacattaggagaagtggcctgcacttgtggcagaccttgtactgcttgtcgctcaattgccattaaatacctcttgttccagatgaatatgtacgagaatcagttaaagctttacctaaagccatgccggacttactacctgttacataggcagatgccagactcggtataccttgcaccaaggtgctcacggcagaaggtttcttaaactcacgcatctgcatctgaccaccacgttggatggacttaagctggtttgtgaagttaatcttctgattctcatagttatcgataattgtactctggttccttccgccttctgctgctaagtcattcagcatagaagacacagagttaccaccagtaccagtagcaccagcaagcaatgcaacctgtgctctctgctgcagtagtgaagtctgattgcttattgcatccgcatgatactgtttagcagcagagcgttctgcatctgccactgtcttatatgcttcttgtgtagcaattaactgctgccgccattgctcctcctgagctttcttcatagctttggcttcatcacttccaccaaaaagattgcctagaagaccaagaccttgcatacctgcactaagcagtcctgcattagagaagccagcagaagaacctcctaagaaactaccaagggagccaagcaaacctccgccacctgcggcggctgtccctcctgctgctgcggcagtaccaccagcagcggctgctgcaccgctacctgcaaacatactaccaatagaagacataccagccataacggctgaacctatagccattagaccctccttttggttggattgtagctcccttcccactcaatatcgcgaagctggaatgtatgaggtgattctacaataatacgataaacagcatccgtgctcttagccctcagtgggaatctgaagacaccctcccttggttcaacataacctactgtgttgttgagagcaccacctatacggtttgacgctagtaccctgcgtactttaccactcttcacattcttaacttccacggagaaatcaggatacatatcaagattaaggtgaaccaaccccacaacaggtacatcaatataggatacacggtcttgcctatctctgataactacaggtgttggttcaaactcttgagggtaaatctgaccaacaataaccttcgcttttacgtggttatcatcatgcatgtcaaaggttgtagacaaggtgttatcactagggttatatttgaacaggaaagaacctccaatatatgaatcccacccttctattaagatgcaatccaaaagttctgggttagtaggagtccaaggaagtggttcagatatccattcatcttctgctttaaaatgcttgaagatcaactctgcttgcctatccattctgatgcggtcattcaaaccataggttagtgcatcacccatgtccatcttctccagatagacgccatcgcctcgctcaaggagtaaataaagtaattcaccagaataaaacatacctcgcacctttgtacccataggccactcccatacatgccatgctgattgtacacggtctgtaccttgccataaccaatcatagcagtaaattatgttacgatatttatcggtagtgacaagcaatcggttgacattggtacttgctgccatgttgataatgttaccttcgataagcttattcacatgacttgtgattgcttgtgccttcttagtgtcactataagagtctgtatagaactctcgtacaccagagtaagaaccatcattagtggcaaacattaccgattcaccagttactactggcttcaccttattgttcacttcaaatgttgtaacaggcttaagcagtgcatttgacttctctaaaggcttatcgcctggcagtatgaattgtgacttatcagagaacaacacggtagcgccatctaaggtcactgcatgttttagctggtagacttcactagcatctgagaaaatatcaaatgggtcagttgccaatgcagagacaaccgtataacgaaagaaatcgaagaagtatgatgtacgagaagcaataaccgcttcacctgctgtaaagcataggcggttctgcaccatgaacattccacctattgtctggggtacttcctcatcaataaaagaaggcatagggttagtcaagtcatcccctactttacgatcttcccaatcaccttgtcttatcttgaattgagctatgccgtcgatgatacctgtacgttcaataatgtaaggcattgtgcctttatcaaacccaagtaatacatcagcagctattgtttctttccaagacacaaggtttccctctttaggctcagcttgcagccagtaacgagactcaggtttgctgccagtaggccacacttgtactttataaccagcaggcgcacgagaagggagtaggtcagtagagctaactttattcttgatagccactaagtccttaccttttgcaccatcggtggttgttattgtaaagctagcaccatcccgtctctcgataaatatactagtaccgtctctttgtatttcatagtcacccacaccgctccattgctgcaacttagcgtacaattcagaagtgatacgttcagttcgaatttgttcaacatggtctgcacttccaccatccggtgttttaaaactagcagcgttggtcccattaattacaatggaataagatgtaccatattgaccatacgcacaaaacacaatggctttgtttccaactttaggtgacttcctgttactagctttaactactttcctacgattaagcatgaaagtaacatcagctatcgtcatgaattgcacatcttcccttggattaacaacctcagagaggtaggtcataggtgcatcttgtgaagtcacattacatttgcgcccatacttatcaaatatctcaggaacttgtcctttcttcaacgtgaagaaatactcttcatcaccatcacctctgcgataatgatgagtagccatgtcatcagtccccgcatcaagtatctttgcaatatgagttgtacccatgcgtgattgagtaccattcactacatcaggtatcatattaaccatagctgtgcactgaccatccaagcgtaccgctggcggctgctggctaatcccttggatttgtctacctaatgaaccttgtacttccattaacgatcctcccacggacggagcgcccaactctcataaggtgaatgagagtaagcaggtacattctgagagccaccagccatgataccaaactgacgctgagtggggttatgtaccagcatgtttaatcgcttctgtgacatttgctcagattgtacatccataagaagctgagtggctatctgctgcgcagtggctagcttagtctgatctgcatccttagacacaataaactctacagcagcttgataggcaatagcctgcattacactagtaggtagatgctcatatggaagtaaggtaagtaaggtaagacgaatcataccattagcattcacatgcttacgcatatcaaaggtatgactccatgtagagtagagcttacctgctcgcatagtcataggtactttcttttcacctaaagcataacactgcaatactgctaggcagttgttaggtaaattaacttcaccgttagtgtctggtgcaagttgccagttcggttcacgattgaaccaccagccacctcctttgttgtactggaatcgctgggatacgatgtcgatcatcttgcttgcatcttctgcgtccaagtcacctgagtcgagagaatccacaccctcacgaccaatagctcgcatacacaagtttaccgcttccagcttactatcaataatctggaaggccacatcttccatcatatgtcctactttactggtttgtctaattacaggcatgaatcctcctaacaaaaagaaccctacctacgcaaggtagatagggcataggtattactcagtaggtttcattgcagtcggcttgatgtcatttgccattacagcacgtaccgccgctacaaggtcttccgcttggatacctgctggggcagcagagaatgcagccgcagcaccttcggttttgacatatacagccttacgctgtgcacgagccagtacggttgcgtgatcattaccagaatcttcagcagcagcaccagtagttgcattacgtttagtggtaactacagacactgcttcccaacggtcagggattgcaccctcagccatgaaggtgtcaatgtaataagtcttctctttcttctcatagaagatgtcaccagtcacttcaatggtacgacccaccagcagtgcgtcggcagtgaacagaacagcaactgcaccattcatctctgcgatagggtcataacgatagccgttatcttcattagacaacaggtggtgagcctgattctgagcgaaggtagggaatcggttagacgggatcacagggcagttataagaagagagaacgaagccattaatggttgcaccagactggctgatagtgtaagtcttatctacaattcggtctgcatcacgcagagcattgaagaacttccacggcatcatgatagctacatcagagatgtccacttcctgctcaagctgttgctccagagcatactctaccgcagccataacatactgagggttagccagtgcttcactctcagttacgttaacgttgatagagaagccatgccctttaacacgcggcttgttacgtttggccttggtgttagcaataccgcctaacagcatctgctgaattgccatctggtcttccagacgtttcagttgcttggcttggttcatagccagttttggtttcaggctatcgatgtcaccttgtacatcgtggatgtgagccacagtgttacgagcaatgacagtggtatcaattaccaactggtttttatccgcctgagtaggggtggcattaggagactgacccggtgctagcacctgcaactcagtttcgcccaaatatttgttgctcactgtgttagtgccagtaacagtttgtacatcaaagtaggacagaatgttctcacctttcaggtactgctcattgaccttaccattaaacttctcaatgagaaggctgtcaacctcaccggatgcagatacagcaacgttagtcagagtattcggtgtagacatgtattataatctccttataaatcaaattgataactagggagagcttttctcccttctatagtgtccagtaaatactgaattagataccgcgagccatgccagcacggcgacgggcgtccagtttagcctgagcttctgccatagctttacggtcattgccgtacttctggctaagagttgcgattgcttgaacgtactgatctcgcgtcagtgggccattctcttcattagccttagcaggtgctgatggctcaatcagggatggcttatcatccccctgtgcctgcttacggcggctctccagttcacgcacagcgtactgctggaggtactggttgccagactccatcaccgcattgaatgccgtgagttcgtcatcggatagagtttcaagcgcccactcctcaagacgggaccaaccttcttcgccaccaatttccttagaaacatcagagaagcgttgggtgttagctgcttccaactctttagctgcgttggcttctttcaggaagaaggcttcattttgagccttaagacctgacaggtaagcatctaccgcaaacttgccaaaagcatcatacaatttctgcttggttgcatctgacagttcaaacttgccacctttggaatagagttccttggcaacctgcttggcatcaatgcctttctctttaaggctgtcagttacatcctgtgggatgtctactgttacttcatgttctccgaagaagtattgcacttcctcagtgtcggtcgcggtatcatctggcttaggttcaccattctctccgccattgtctcctttttctgaaggctgtccagaagcttctcctccggtgtcttcagtaggttgtgcaccagcattgtcatcttgtacagcagtgccagcgtcagcaggagcatcagtagtagcagcatcagttgttacctccttggtttctaccgtaccctcttcagcagtagggtgagtggttgacggttcagtaaatgagaaagacattacgcctccttaagttcttgttgaattacacccggcacggccttagccacaccttcttcaagcatctgtgcttgctgtgcttgcatctgtacttcctgttcttgtgccatctcttcagctgatttaaggaacggcagttcagcagagatttgaccacgcacccaatccatatagtcaggccatttcacagcagctaggacaggctcaggccattgtaatggcagtgacatatactgagcaaagttagccagtttgtccaactcagccatgcgtcctaaagcttcaatacctgtgataatcacagggtccactaagtcactagtgaaggactcccctgcctccagcagaccccacatcgctactggcgattgcatagtagtagcaaagagggagtataccccacccatgttctgctcaatctctaacgcatctcgctggatttctacagcagtaacacgttcggcgtcacggcgtgtcattgtctccatcatgaagacaacaccgatacggcgagtgtatacctctagaaccgcgctaataggtgtgaggtctgcgtacttacctaactgtacaatatggatgtcttcttctacaccagtgacaacctcaccagtgccagagttaacaaagtggtcaacatcagtttgagcacccggacgaatcaggtacttgatatctgccatcagcgcagcaccacgggcaaccgcttcagataagaattggataacgaataaatcaccggagtaatcctctgcaagagggcgaccccaatcctcaccatagcttcgcttccaagttaatgggatgaaaggtagcttttctgatttgattttactcaccttacccacagggatatcatcagcagattgcttgagttcccaaaatccatcaccaagatacttagcatgtgtgtacagcttaacgctgtcatcttccttgcacttcttacttttcaggccaacctctactacagcacgtgtagctgggtcaaaggtacgtaaggctttctcttgtagcaagataatgtctaacaggtcgccattggtatcacggttaactacatagtgatgcattgggatagcactgattgcacctttgctcggcttgtatagcatacagctaccagcaacaataagatgcttgaatgcttccactacagcaggccggaattgacgttgctctaactctttcattgcccgtgtttccacttgagcgaagatggtagctaactctgtcttcttcaggccacgctgattaagaaccttctcaccttgtgcagttaagtctacacggaagaaggaacgctgtgcagggaatagtacttgcgctagcttgttggctagatgattagttgcctgagcacctacaccttgccatccattctgcgaagtctcgttatcacctttgtcattcatcagatagggcaaggttaatttggagtaatgcttcgccctatcaaggaaagagctacgtttagtggagaacttctcccatagcttaggtatcttagaccgcttacctccatactccaaatctgtgctctgtttcatattacaccttcaagctagaagctaccggacggacaaggccgcgcttaccttttgcagatgcagtcgcatcatcaccacctgcaccaatttgaatatcttcagcttcagtctcaggcttacgctcaagctgctgtgctgggactttggcttcaatacgtggtgcatcttgagcaagaccgatagccttaaatgctttctttacaacactcatgttatctccttagaacttcaggttatacacagtgccaaacggttcaaagccaagtcgcttatacatacgtccgacacgttcttcattaataccagaggcgatagacaggcgaacctcagagcattcattatcactagcccattgctttagggctttgatgagacgcataccaagtagtgttcctcgcctctctggtataatataaaagagaatgtcagaggcaactcttacaggtgtccaaggggccaactcgtgatagccagcccacaggaaccctacaatctgcccttcatctacagcaacccataggaataaatcttctctactaagagatgcacaaaggttatgtgcactttgttctgcattccatgaggctgagtggtgggctacaaccttgacttcctcttccacatatttattcccaaggtttataatctcaggaatatctaggaaggaagctggacgtatcattggaccaccagttgtgctctgacacaatccatgatgtaacgcttaacttcatcaacgattaactcttcatgagtcttagtcaccttaggagaagaaggcttgagaatcatctcaagcatttccattccttcaaatgaaatcgtcggtttcttcttcgtctgtaccatataattcgtcaaccttctcttggatagcttctacagaaagaccaagttcttctgcatcagcaagtaaagtatatggcacttccatgccacaggataaagtttcgaagatagcttctgctacctcaactgcacgagttgccttcatgctatcaaaagaaatctggttcatctttgtcatgtcttaattctcccgctttgggcagacgaatgttgcccttgcttgaatcctgaagaccttttacttcaaagattttaccaatgacattcaatcgtccaccatgtttaatatcgtggaacatctgttctgcatctgcatgagtccaccctttacctaacatagctttgattgtcttgccccctttccatttgaaaatgaggttagctaccttacctttgtacttacctttgccttcttcaaagccaatacaagtaaggtcataagttaccttacggacttctttagtctgacgataacctttgtggcctgcttcataatcacagtccagtttaaacacagcaccctctcggcctgcgtctatttgctcttgcgcaaacgcttcaacttctcgctcattatggcaaggagtaataggaaggatagcgttgtacccgctaagatgagcgccgatgcgacgatgtaaagcatcgtaacgtttgagataagaaacatcagtgaatccatcatggaatgccttaatggttaacatatcgaagaagtcgatatacaggttgtctttaatctgctggcctataaagtcaagcggctctgtacgattaggatttaccacccctgatagagcttcaaggtagatatcaacggccatagactgaagctcaccaagataaatgccaaccggaaaggtagcaaatgtttgttcgaggacttcagtgtttgccagtttcttaccagtgcgaccaaaaatgccaacgacaccatcagtgcgaacaacaacagcagaaaagataccatctcgtttcacctgtccataacatggaaaagtaagtttcttctcagggacttcaccgcgatgtttcactagcatgaatgggtgattgcggtgatcttctggaagacctaggaactcaaagatattcatacagcttcttcctcttcaatggtagtgtcgcagttatgacagaaatagaaatgataagtatctgacataactacatgttctgtttcttcacttccacaattaggacaagtcatatcaaatatcctcatcaatacattcgtgacgatgtttctggaataactctttatagtagtctgctttcttcaggtcttcttcagtattgaatttcttacctgcacgcagacgatacttcaaagcgttacccatgcaatatccagcaaattgcttctcggtcatactacgagcaatgatagtgattacctctaccccatcgaagaactcatagtgcttaggcttagtaaccatattgttgtccaacgtgctaggatcttcatcttgcaatgagtcaacaaccttgaagtaaggtgcataccattcgcgcttctcaacaccttctaacataatagagttataattaggttctgcacgggatactttgaataccccatctggtttcttgtctaggctttcacacagtttattccagatggcatctcggtaagctgcacggcgtacgacgtattcgccaatataaatctttgacataattaattcctccattcactatacaatcaagggtaagctaatacctaccctttgttctatagtgtcaactaaatcttaccaatccagcgattgtcactattggtctgcatcgggacaatgtgcggcacaccctccagaataaccacacaacctaatgctggcttgtatttggactcacgaccataggcaaatgcacgagatgactcatcaatcaaacagccgccctgcacagcccaatactgttcatgtgtgttacgtgcatactccaccgacatcttaccatgcaagtgaccgcacactaagttcatgcgctcatgcgctgcatctgctaagactgagcctgctggttgatgcttaaatgcaacctgttcaccattcggcaactcaagaacgtgtgtatgctgccaatcccactggtcgccacccccatgcggaaagaagacttctcgataggtacgcaagtattgcacagggatacccttagcgcttgccttacggaagtgcatagagccgtgattagaatgacacaggcgcatcacaggaaacatcttgtgtaatttatgcataaagacacgggccttctctaactccatgccagcactatccagattggggtctgaatcgtggaacgataaggcatgtttatctgcctcatcccccagatgaactacagtgtctggacggtaacgtgctgccaccgctgccagaaactctaaggtatctgggtgctcgtaaggtgcatgagtgtcagggattaccagtacacttcgatgaggcgagtcaggcagtggtacaatagccaaatcctcgtagcggtcaggagtcctgagcttacgctcttctttgatacgcttatcctcttgcagaagagtctggtagtaatcaccattcttcttggtcttcttgaattgaccatgccagtatcgagccaactggcgggtaatcttcttacccacagggtgacacgataatacccgtgccatctcgttgtagttaacattacctttctcgtcggtagcttgctcgattgcatcaagtacctcggagtctttgtacaagctgcgaagcttacccaactttaacctccttcttctttcttgcataagcaaggcgtgccttacggttcttagcctcgcgcttctctgcctccgtttgatgtttgtgatataacttatctgtctgaggcgtactatgtaacttccagtattcgtacaatctctctaaccattgaagctggaagtaacggttattacccgccttgccataaccagagataacacccttaatcttcccttccgcaccattgcaacctcggcatacaacagcacggcagaatcctgtctcatggtcatggtcaagtacacggtttacaggtgtgacagctttgagactgccaccacacagagggcatttccatccttgcttatctagcaattccttcttataagctgccacctccgatgcttttaatttgctaaccattccgcatcatctccccacaagattgggttcttatcggctcgccatatatcacctttgaacctagccatgtgagctaagcgaccgcattcaagcataaggtcaaaggctttgccgatacgataaccacctcggtaattcttaattttaacttgtccatgcccgaacttagccttgtaagcacccagcactgccatgtacaactctttctctgtcttacaatctttgagaagatcataggcatatttagcaccacgacctggtatgccagcatagttatcaatatcatcaccgataatcatctgtgcatagtggaacatgaggccagcaccttttagatctttgacttgcccattagccttacggcgtagctcaagccagcccataggctctacccacttcttctcttgacccggctgaagatgccaaccgggaacaatcatcaaatccttatctaaggaaacgatgcaagtatcagagaatgctttatgctctggactaccgatagggaactcgttacctgtatcttgcaggaagcggcggtggctatcccattgtgcgatgctcatgaggtcatcagcttcttctccatctgccaagattgcaccatgaacctctaagagatgctctcgcaattcatagaagaatggaggcttctcggtcttacgttgacccttataaggcttggtgaatgctaggcgaacacggaagttagcttctgatttcgtcatgaataacttagctgcatcacattctgctgcatacacccaagagttaagcaaggagttcacacggtcacatgcttgcttacactcaggtgtatctttgattgatgggacttgtcctgacttaacacgagttgtggctcgtacataagtcatgtcactgatagtataccctacgatgtaaggtaacatatcagcatctattaaagcgattcgattaccttcagtcggccacagcagcaggttattgtcttccgatactgtagctccgaagtcgaagtttggtcgcatgtaggccactcctctaatacactgagtagcaccttgtctgctatggcctgatatgtataaccccaataacctaaatcaaacaattcaggaagggtgaatgttttagtgtgaaacacttctccatccagcaggatgactactttaaaataatcttgcattaactttaagtcacgaccataaacatagtctgctactaaacgagattcaatagtcggcataattcattctccaataactattacgcaaaagaccctgcctacactaaggcagacagggcattagatgaggtgagcgtgatagtcaactaggactaacagaggctacacctgctattatcaaaactcttcctcttcgctaaccggagcttcctgtgcagacacttctactgcaggagcttcagcttcttcagcagctttaacttctttcactggtttaccagcagcaatccaatccagatattcagctacgatgttagccttcccgatctgggctttgtcagcctgctcagggaagcaagcacgagcgaactccagaccagcagcgaagttacccatgctgtcaatcttagcctgagcttcttcacgggtatcgtaagccttagtaccagctaccagttgatcagcttcatcgacgataatgaaagactcaacggataccagagcagcacctttaacaacacggtttacgatagtttcaatcttgaacatattaaattctccttttgttggttatggcattatcgccgattaaaattcttctcttctatagtgtccagtaaataccggacaccgatttgtctcacacgtgagactttataaaactgtgttcacctgagcaatgtcatgcgccggaagcgatacgccgtggcgtttccccgtagctgggtcgctgtagttcaccacgtgctgtccgtcgcgccagatgtagtgcaggtcggcatatgtgtccccttcagagaaggagtgaaaagtgttgccgccaagagttgtaattcctttcttgcagtgcagggttacgatttgtactttcatcctttctccttaatattccgcgtcctcatccatctccggtgcaggtgtatcttctgcttcaggtacttcctgtggaacagactcaccagtatccagagatttacgattagctggggtagcatcttcctcgtctttcttcttagccttcttccattcagggtcttcttcacgagcagctttgataatagcttctacgtgagagccagcaacagacaggttcttaccacgaggtgtctcgttcaggaagtattgacgtaccaagttagctgggatgtcatcaaggatttctttggtcagcttgtcgaaggtgatatgacctgtcatagacagaccttcctcttctacctgagccagtacaagcttcttcaacttatcaggcataccgccaaagcctttccagttaacatacttgaaagtaccatcatcattcttgtcgccagagccaaccatagttgcagtcagacattcaccgataaaatcatcgaagccacccagcaactctttagggtcaactgcattcaggaacttagtcagtgttgccttatcaccagacttcagaggcacagccatccattgttccatgcgagaatcatcttcattcttatcgtcgtcacccatcaggataatcttaacaagaacaaagtttgctggcttcttaacttcagtggtattacctttcttaaagatatcttggaaggaaccaacatgaatgatgccagagattactgcttcatgatcaccaacttcagggttcttaaatactttaccttcagctttagtaacctgagcaccaaaatcaaaatcaccacgtgccatttatttagtctcctattgttacactacacaatcataggccgaactaagccgacctattgttctatagtgtccagtaattacttatgaactaccttaatacgtgcaatagtatctagagggtagacataactaacacattcaccatcttcaacctcttgtacatttacactagccatagtgtcacaaagtgaaagactcaattgatgacaagtttcaccttgagtaaactctggaccacgatatgcatctgcttgttccacagtagtgattgctgtatcgtcttctttagccagacgagtgtgacctgcaactttacgctgctctagatcacgaaagatgatacctacatgtttagcttgaatcacttcttccatcataacccttatttagtcaagttgtccagttctatttccagcataacaatctctttcttcaggctgtcagatgcagcttgatttacaagagcaattgatgccttgttctcttcaaattcagctttcaggctgtcacgctcttgctggtgacgtgccagcatatcttctacctctttgacttgacgtgcatttagttcatcacgagatgcatagtagcggttatgacagtcaatcatttgagaactacgatgctcttcaactttaacttgctctgcctgtactgcttcgatgcgagcctcaatagctttgatagccttggacttgaacttattagcaagaccacgaaagtattgagccacgaataccagagtagttaccatagacatatttatatctcctatatttacttaattacctatactaccttataaacctagattacctaggatttccttctatagtgtccagtaaatcatgttagacaaaataagtaggaataagttattcataaaggccactcgtaagtgaccttgagtataactcagtcgtagttaccatcacaatctgggtcaatgccagagaaagcccagaatactaccataaataatatgatcccaagaatgataaaagcagtttgcatcaatcgtaaccctcctcttcatcaggtatatctaatcgcatacttccatagcaagcaaatataaggaatataagaaagaagatagagaataggcaaacaacgtcaaacctgtccatcagtgtgtttccttccagcttgcaccaatcttatactcacctgccatcggacaacgcatcttcaaataatgaccagcccaagtcattgcatcggcaatgatatgccctgcacggtgataacgacgctggcaatgaagtacaccagcatcagcatcaacactaacgagatttgcagcagaccacatacgtccttcagaatccacatgaacacgtttctcctctgcatcgaacactgctttcacagcagccttctctgtttcgaacccttctaaggtgaaaggcaagtcgtagttgagatacaagacctcatcttcagggacttccatctggatttcatcgtgcacgttagctataccgcaagggtttcccatgctatctaaggccacaccttccttgcgcatcactgcaaacgctctgaccaatgcgtatttcatacacagagaaccagtcatctggagtagtacgttaagcatagtgtgctctttaagttcaccaccagacatacggatgcgaccccaatgaccatcaggtgcttgtaggtagccaaacttgttaccttgtgcgataacattctcacgaagacgtgcaagagatggtagttcaacctcaaatcttgccacaacttcctccatttcttcctcagtaacaccacatactgctgcaaggttagctataccagacccatataggaaggcatatataaatgtcttcgccatgtcacgcttaggaagaccagccttcatttgattatgggtgtgaatgtcaccatgcagtacaatatcttgatattcaggatcattcatgaagtgagacaatacacgtagttcaagaccagcaccatcacaaccaaggattagcttacctttaccggctatgaataaatcacgtaaaggatacaaaccacgggcaggaatattaaccacgttacgatgacgcatacggaacgtagaagttccaatactaatagcaatagctggcacacgccattctccgtcatccttgtctgacgtaggccagcatccgtacctttcgtagtattgctgcgcattgattcctaactccttgttaaatgctacaggtacaaggccgcgacactttcgtataccagcttgcgaaggccacacccccttctggtcgaaggcttcaacgtcaccacggttgaggatctgaccacgacgggacacgagtatataccatgcagcgatacccaagcaccaatcagggactgttttaccttcacgtgcggctctttcttgccataaagtaagggacttttcatttatcttaccactccaaggtttgggtaacactccgtgctcatcgagatgcgcttgctcggtatcgttaaattcaacacctttccatccataatcatagagcacttgcttaactgtatccctgttacccaagggaatctcttcgaaagtaacaggcgagtaagcgccaatccacttgatgcttggcgtgtcattacggtttcctctaaggtgaggaaagtctttcttgacgctagccgcccaatcaccagacttagtagtgacactccatactgtcttgcgatctcctcgtctctctgcgtgaagaaagtgagaggggtcaaggacagtaggtatattgttgctagctccatactcatttgcgcgttggcatacttcattcttttcttccggtttaaaaggtttagacttgatacgcagaggcatgtgcggacggaacgctgcgactgtctcatcaatcttagcgtccaattcctcgcatcgtgctaatgctttatctatatccagacggaatccacgctcggcctgacggctcatctccagcgccacaatggactccatgtggaaggctgtctcaatacctaggccagtgcgtttattcacgccacggcgtttgtgctccatccattccccgttaaagagccagaggaacaagtcacgaccaatcgccacgtcctcgcgtacacgatgtaccatgtggtcagttagtttagaccaatcctcgttctccggcttataacggcctatacgaatgccgtgcgcctcaattgagtgaggggctacgttacccatgcctttggcgtatgcttgcggagggaggcgtctatcggggtttaacaggcgactcatgaccagcgtatccatgacgcgtaccggacacaggtcagcgcggagtctgcccttgccgcgtctctcggtatagttaaagcctttccagatatcagggaatgctttctcaaatagaaggccgtcgtaccctaggaagttctgcgacacaatagcttcacagtgcttcaggaagttaacaccatcaaccaagtcaccatcttgatgaccttcccattccttcaggtgttctcttgcttcagggtcacgcatctcatatgggtcgaagaagaggaactcctcagtggtgagcaagtccatgcagcaaatgatgtgtacatcttcgcgatgaccgtagcggatagcatccagcagacctttagcttccgcatccattactaagatgcgcccttctgcttccttcttccaatcaattgatttcatagattgctccaaagtatttaactctaagacttttacctaatacagaatcaggtgtagctttaagatcaagatacattaagtgcatgtggtatttattattgtgatctttctgccttttagtgcggcagttttcacacttaccatcaacacgactgcgatagcctttaccgcaagagcaaaccttgcttaatttaatagtcttcatacattgcctctgtttcgtagtaatcatctgaacgttctggttttggattcattgagtcatagtaattccaatcagaatcataatcacttggcataatgcacctccaatcaatatgatgaaaggctgtctcacgtgtgagacaaccctcgacttatcgactgcgaatcttacgtttcactccaccttccttgataacctgctcacgcgtcaggctgttcttctttgcttcagctatagttaactgtgcaaacaggaaggcttggttagtaatttgtgcttgcaggtcttcgtgaccatcgaacatcttaaggctgtgtttagacataagagattgccacctctactttgctacctacccaatgacggtgaccaccaccattacctagtgcagcgcctacgccccagccaatacccttatcgtttacataaatagttcgaccttcttgataagatctaacaaagaccatacctttagcattaaaacttacaatacgcatacggcctttaaatgtaccacgacgtaattgtttctgagcacgcttgatgcagcgtttgattgcacgttgtttcattacttagtctccaccataaaagagccaataactttaaaatctttacggaactctttttcagtccaatgaccgaaaagttccctctgaaaacttacactacgactggcacctattaatgccaacccctttgaagtaccatatggcttgacaccatctggtgctacaactgcatagcatttatgaggtccacgcatataaattaataccttagtcatgattaaccccttagatattcacgtatgtttcttcagtaacgataggtagatacagtaattcttcaccatttaagatgtgaagacctttcaacccttgcttacgaataataccttctatagtgtcggcaaaatgcttattaattacacgtcgttgcgtaccttgttctgtgattgcatggtcaacatccatgattcgcacaggtacatttggatgcatcatggcttctccaatctttaccatagcttgtcctgtggatttacccaatgcacgagtattaaactgtgtaacacctaatgcagtgccacattgcttaatcatctcactttgagtcttaccagtgattacattgcgacgctctttcttgagtgtggttttcttttctgccatgtactctgctagtgtttgagggccagcaccataataaagaggagctaggaaattcttaagcatctggcgagcacatttatcgcaaaccttatcatgtatgcacttacattgattgtttatctctacaatcttttcaagatatttatgtgctgtcttcttgtggtaatactgcttaacaccactgtgatattctacataatacaggttctcacctacaaaggttacaacaccacggcaaagatagcgacttgaatctttcttgatgttgcgtacaaagtcacctacattcaacactaagttatacataatcaatctccagttatttaatgtacttaataagagcctgtctcacatgtgagacaagccctgataaatacactagataaggcgtgttacaataaagaacattgacataataaaaccagatgcaacgataagtttcacagctttcttgaatccatatcgtgcagcataatctgcgatcacaagcatgaataggatctcaataccgatattcaatactggtttaataatttccattaaaactcctgttcatcatcaaaggttgtctcttctatagtgtcaggtaaatccggtacttcttgttgccttgcttcgcctgtatcaaacgaccttgttctagcttgtggttctctcaaacgtccggtctgaatgtcacccttgagcatgactttggttcctgtgtagataccttggtcgcggtctttgacacaagagatgtacgtggtagtcctttcatcaagcgtttcagctcttgtattacgctcaatccccaaggcgtaagatgcccagaatccgatagcgcctgagcctcggaagtcagaaaggataacttcgccaccttcttcgtgttgggtacggtttgccggaggccgtgtaaggtgagagacaaggaaaatcgtaaccgcatgtcggtctttgatagtaccaattcgtttgacgcattcatcaagtgcaccaaccttcccaccaaaagcacgctcatctaatttaatccccgttaagttatcaatgatgatattagaaatgcccatagcctcaaactctaggcaagtttgctctaccttctccatagaatagtcgccttctaggtcagccacaaatagctttcctgtatcagccacataatcaatggcagcgttagcttcttcctcggtgtagtcgaacacctcacggtatccgtcttctttcgggtcgttggttggcggtaactcaatacgcttatcaatccacttgccgataaaagcacgggacaccttgaccatcgggtcttctgtagaaatgatgcctacagattcaccgtgttcttcaataagatgtttaaccacttcgcggaggaactcagtcttacctacaccagagcctgcacctacaatgataagctggttcttacgaatacctagcgttaccttgttcagcttaggccaaggccatgataacccttgctctggacgtgcagccttgagcttatccctttgagatgcgatagatttaatctggctaccaaagacttcatcagatgacttggcattaaaccaagcatcaacaaactctttagccttgccagccatcaatgccttgttagcatctttgcaaccagaagggtattcaaggatataggatttgccaggaaacaggcgagccgcttgctgattctgcttctgccccacctcatctccatcaaaaccccatataatcttcttgaattgggcgatatgctcacggttctgcactatctcttcaaggcaagactcacctttattgacagaccatacatggtaaggctggccttcccacttagtacccttggcagaatcaaggagcatctgctgtgctgctagtgcatccagttcgccgcccacaataagcaagcaatcctttcgtcttcccttgtctaacacgtgagacaaagtattcataccgaaaagatcttgcataccaaagagtttacctaaatgaccaaacttaaagtctttaggtaatgtgcgacacttggcgcctactagctcacctttctcgaagcgtggatagtaatgccgtgagactctaccatcttcatcgtgtccgacacgtacatcatacaatgcgcaaatgtcgccgcgaatgtgtcgggaaacaagattcttacgcttaagcgtgaggaaccattcaacatcaagtttccactctgcttcttggtctgccctttcttgctcattcataacctcccaacggtctttcatacgcataccaccaagtgcgatggcgcgtagcttagggtcgctaatcttcccttccttctccatctctttaaactgagaaggtgtatatttgatattgccagtaataggtaattcggttatctcgatgccaccctctggcttatggtaataaggcttgccgttatcatggaagtgaccacggttacagtaaccagcgccatcctcaaatatcataagatggttgccagtaatatcatgtccattcttttgacaggcaggacacggtacattctgaataatagccataacttagaactcccacgcagcgcgtttagatgcacggtcacggacaggtttattcagcttcttgcctttcgtctgcccttcttccatgtcaaaacggttagctttacgggtcatcttctcaaagttacgcatggttaaaaaaatctccaaagtgagttagtcttatctatactgtccggtaaatacgaagtctcacatgtgagacaacctaggtctgcccttcctctaagtggtaataagaggaaggaagaaggtaataggtattcctgggtattcctagataacctatataacctttaatacctattacttcctttatatcctttatcttccctttctttcccgtctccgacggctatcctatagtgtccggtaaataagtctcacatgtgagacacttttatgttaatgaaatgttacaggtagtaggtaaaaaaaaaaaaaaaaaaaaaaaaaaaaagccactccctaaggaatggcctattaatattatgcgaaacaatagtctgaaactaagatttcgttaaggtcaaactctccttgctctggtacttggattccggtgtctactaaccaacgctcttcgtgcacatctagcaggttttgcagggcattatggttttgatacatcttaaccatttcttcccttaagctatcccgcaggtctgcggtacgtcctgcatgagtaccgaaagaatcatggatgactgcaatggatgtaatacctttatccactaggtcacatacagtcagaatcaggtggctagcatcgtgaccatggacgaagttaggagcagccgcacccatcattgccgtttcatcaactacatctgtttcaatctggagactcatcttgatttcacccatcaagcaagtggatacgcggagcatatcggtagccattatcttttgttgcaagatgaagccagttggtaagggatattctaagccttcgtttcttttagctgcgaaacgtgcaagctgacgaatcattttcattgccactataggagctttaaccacttccgaaatagaaggccagattaaagctgtcatatagttataagctgcgctaggtgtcaggctgtctttgcggtcattatcaaaaggatgtacaggattggcggtacgcccttccgcaatagcccgttgggcctctttttcttccaaatcaacgatataatcaatcactgactcacggcaggttagacgtgtgctgccgtaaggtagtgtcattacgggctttttggtcaggccgcgagtgattcctatcatatcccacgcactagccatgctacgcagttccgcacctgttaaagtcacgctgccagaagtgaaggtttccgcatcctctgcattcatgtatgcataattcttctgaattactacctgcgcaacggcaccataaatatcttgaggggagtcagagggcttaaggtttaccgctttcgcacctactgcatcgcgtagcatagcactgtagtgctggataccagaacaactaccatcttgatggacggggaggtgcgtcatgaattggtcttgcgtgccttcatccagtgcatccagataacgcgcatattcaaagcaccaagcaaggaagccgtaaggggagtcggcatttacccattgagtgaaggtaagcggatccgctgcaatgtcgcggcacatgtcttgaaattcactatccagcacgttagcggtgcgcacgtcaaaagtcttcttatcccaaccccagttattagccccgttcaccaaaaaccatttaagcgcctcagcgctatcaaggcgctgcccttcggtaaaacggagcaatgccttgcctaagtcgtttgattgcggagagagcgtgctagattgcgcgtagacgcggctgcggctgtccagtgcatacacgaagtagatggcgtcaaactggctgtatttacgtgcctgcccaaccatgcggacggtcgccgccgatttgctgccgcgcttagtttcagcggtatacagcttggtacattcgcctttccagttgatgaaggcttgccattgttccggcgttagcatctctttaagttcacggcctcgcaggtgctggaactctaacggcactggattagctggcttgttctcacggtcgatgagtggtttaaaggaaggcacaccatagccgaggtctagacgtataacgtcctccacaacctgtaaaacctctttattaacctgccacttagttgcctgcaaagcgttaacagccttataaacggctggcatttgctttttggtcagcttgcggacgtgctcacgattgccttttaccagacgaatacggcttgctactttctcagtatgaaacccaccgttaaaaggtgatacccaagggcggggaggtataacgcaaggtgcataggcagggctgagctgcgctacatgttccttaaatgcagttatccactctccaacatgttcactggtctgtaaatagtaaacaccatgctttccgccgttagtgcgcaaggtacgaaggaagacaggttgaccattgaagaatacactattctccaatatttcgagcaaggtcataccgatttgcagcaaggtgtctttaggccatgcctcccaacgggagaaatccgcgtcacggtcagcaacagatttctcagctactaccgctacgttgtgcgcatgacgataagatttagtcttgctagccttaagtgacttcttcactttctcaaagtacttagctgcgtgaccttccagcttgctaaaacgtacttggtcttcgatgcggtctgctacattcatagcgatagcttgtaaggtaacgtctgtattcagcatatccataacgattttcatggtgatatatgctgccacttcgtttcctacgcagttaatgaaagctaatgcacgtggtgcacgacctctcttgccttcgtattcttccttgtaagcctgaataccttccgccataggtgcgattagttcggacaataagcgtcgattccatgccgtgtctgattcattaccggatgcaatctggcgttgttggtccgcttcaaagcgacggataccgccgttaaacatttcttcttcaagttgaagttgaatagcgtgtaggtcttgcatcttgtttactcctagtgaaagaaaccttaataggtgacacctaagaagatgccaccgataaggttacttagtcaactcttctactgcctcagagattaagggccatgcttcatggccttcaccgtagcctagcttaaccagttcgcggcgtgccttgttaactgctgttttcttcgttgcctcctcagcgcttaaacctaagcgagcatagaagcaggaagatttgaattgcggcagcataggtgcggctgccttcttgctttcgcgtgcgctacttaaggaggcgatgcggtcattagctgcctgtaattgctcagtcagtgccttaatttgtgctaagaggctagccatagcggcgttttcggtattagccgtgttatccagcggcgctgcctttggcgcttccggcttgctttcctcttcccatggtgctgattcgtcggcctcctgctcgctcgctggtggcactacctgcggcgcttgcatttcctgtgattctgcggcctcagtagcgttctcctgcggttttaccgcctcagccttagattgtaccgtttcagtctttatctctttcttaggttcaatcagggcgtttacggcattagtgtccagcttgccagctgcggcgagttctgcggccttctccatgattatattttcatcagcgaaaggaacaagcgccaacattacacgcatagccacacctttaaagcgttcgtctccttcaaagacacgggctacactcatcagcttgtagcattgtgccttcttgatgccgaactctgattctacataagctaaaaagtctttttgaccttcgaaatcaccgcgtaattcattcagacaagcgccaactttgatgtaagaagtgccgatattgtctaagtgctgcttgatttcagcggttgcagcttcacgaacagacaggaggacgttttcagtagtcatagtaatcaccttatatagtgtaagtaagtatcacatagcccactcaggtaggctataggctagttactcagtgatgaggtgaaataggtagataccataaggtatgtagataagtgcccaaatgattggattcctcaaagaatctttaagttctgcaatgaggcctttagcggatggcgatagtttcataatcttaacctctagtaagtgaaagtttaatcaggcgctaccgtagcaacgccttgttaagccttctcttatagtgtcagctaaatagtttgtatgtagtacctagcacttcctcacgaatctgcgcaaatcgtaaggaacatttcagggttacaccgtctgaaaatatgaagttatattgcctttccatcttattattcctcttcttcgccttcataccaaactacatcgctgtcatttggtacatcattataaagagcttcatagatgcgagcttgtagaatcttggttacatccttcgtatcaggaatcaaaccagcatcttcaaaatcaacatcaatgccatcagcagccatcacagtaaagatttcgctgtaataaactggcaccatgctatctacaacctcatgcagtgcatcagagtaatcatcatcttcacgaatctcatcgtacttgatgcgctcgttgaatgcttcaacagttgcagccagaaggttgtagtaagcgttagcgttgcgttccatgatttaatcctcattagttagttaggttacattatagggcactcaaaagaataccctaggtttaacctatccagactaagaagcgactacccatattgttaaagagcgtggcttgtgccttgataggctggctagtgccagcaactatcttataagatactattcacaagtttatctattttagcattaattgcaaccactttactataaagtttatcgtgtttgctcttgtctgtgttagcttgccaagcggcataagcaacagcaagtttctcttgcaatgcatcatagcgtttacgttgtgcgttagtcatgatagttcacctttgttagtaagcctatcaagacacaaaccagattgttaaagagctagagattagactcgcgggtgtgctgccatccttacgctattgctatccataactgggctataaagctgggcaatccttttgccaccagtttaattgtgggaaagcctccttatccctcacaccgatactcccggcctaatctctattgttaaagagcgtgatgtttaaagacgtcgccgtcttgatgcttaatgtaaccttgtatgccgtggttgtcaatagttaatttagagatttgtcgtgattacttcatcgtaatcataatcttcactacctagatactcagtaatgacttggttgtcatactcagatactaaggtaactcggtgatattcagtgtcgtaatctagtaggaagtgatgtacatcaacacctacgccagcttgtagcatatcatcgtggaagcgaatagcttcgctagatgattcaaaaaaaaaaaaaaatacctcatgttgatacattatttaccctccctcaattcatctatcatgttacggtattgattaactgtatcggtccaaccttcgttaaggaatcggtgatacaaggctaactcatcctccgtaagtaattcgttgttacgaatcatgtagcacaacagagtgaagagaacggacagttcacggttatttagagtcatgatagaaactccataaagcctccataaactcagcgaaggttaatgcttcttctccttcatctaatgagtcgaaatagacttcatacatttcttcataattcatagttaattcctcattcaataagtaattaaccacggcatacataggttacactaagcaaattgttaaagagcaatgtaagcgctagtctcttcgtatgccttactagctggctactaagcacctcagtgctgcctacgcgatgaatagtattacattgagacggccttgtcaacactaagctatcatcactaagataaatctaggttgtctcacatgttagactaaggaaaagcaatagatacagagctaggataggctaggttggctaggtttctggtgttcctcctactgcatcttattactattacctactcttagcggtctaccgaccgcgacctaattgcatcttatagctttagctatgcaatcactaagagaagacactaagacttactaaggtacactactaagctgatactaagctaagcactaaggctttaactaaggtatcccactaaggctaacctaagccatccatcaggattataccaaggatacacaagcgcggtgagtgtagcgtaacgtagtggagcgaaacgaacagatagcccacccacgctcaccctgtcaaacgctcaggaatggccctaaaacgccctgtgtaagccctaagcggttgcactaaggcaatcaccttgtccaatactaaggcgtgccctagcgcttcctaggcgttctccttgtgcagccactaagagcagacctcggcaagtcctaggccacccgtcgaagacggaccagcccagcccaattcccaagccaaccgcagcgcggccccatatgggggaaatccggcgagggcgagggcgag

SEQ ID NO: 7 - DNA, 167810 bp, artificial sequence
  BP970
tatagtagtcctatcaaaacaaacggagaacaaaatgaaacttttgcttatcgcttatgttgtagtacaatacaattatccgatgtttacttataacatggtaaacggcatagtgaatcttattgaaacgagtatggtaaaatgacccgtgaacaagctaataaattgatggaccttatccgtgacttacgtgaagctgattcagatttgaatgatgtagcttatcatgcggtaaatgataacggagacatttatgaaaatcaggttgatgagtgccagaatgctttggtgaattttgttgaaactttaattggtgaataatatgaaaactgtaattgaaacaaccgagttgtttggcgatttatgtatcgaaaaacgtggttatgcttacgttctgacacaagaagatgatgctgttactattcttcctatggaactggacaagattttgaaactcaatccgcccggccatgcatctgtaattaacattgatgaagaccttcaagttcgtttttatcacggtctttatagtggggttaatatcgaaacagaagatgaatgcctttctatcaataattggaaaacattcgtcactaaggtgaaagaattaatggaatctgaaacagccaaaaaggccaaacttcaatgggctaaatgccgtaatgcttttattacaaatcaggaccgccctgactatacaacagtcctaggcgttaatccttcttatgaagacggtgatgtcgtagttattcgccaaattgatgaccttcgtcagcatatcattacattagacaaagatgaagcagttgctcttaaagcttatctcgattctattatcccaactttgaaataaggaattattatgattatcaatgaaaactcttggcactttaaaatttatgccgcgttcaatagtacatggaatcgtccgaaaacgttgtgtgcttatttttggaaaacgctaatcccggtattagctgtttcaattattggatttgcgattttagcagcagtcacaatcattggccaggaaattttaactaaattctttgtttttagcagtctatggacattagttccagcctcaattggtgtaggcattttaatggtagcagtcatggcttttattgctaccgggttggtaattggtccgtcttggttgttagacaaatataacgacagaaaatattataaagaaattgagctcattgcacaaaaccaagaacgaattaaaaatggacttgagcctattgaacgtaagaaatcattaataggtgaataccttaaagctcgtaaagaaaaagtctgtcctactcttgaatataaggctaaatgatgaaaacaattatgaaaggctactttggtagccacctttatggaacgtctactcctgaatctgacgtcgattttaaagaaatttatgtccctcatgctcgtgatatcttgaccggtaacgttaaagaacacatgagcaagaacacgaataacacatcttctaagaacacaaaagacgacgtggaccatgagttatatagtctcaaatatttctttaaactagctgcggatggtgaaaccgtcgcattagatatgcttcacactccacaaagtctagtagttaaatctgatttgcctgatgtatggaagtatattcaagataacaggtctcgtttctataccactaacatgaaatcttatttagggtatgtccgtaagcaagcttctaaatacggtgtcaagggttctcgactggctgttcttcgtcaagcccttaaacgttctaatgaatggggacaatactttgataatggtgcagtaattcgtttatcacatatgaagaatgttctgcctgtaggtgaatttgcttcgtgggttgaaaccgaaaacgagaaaacaggtaagcaaacattctataatctgttagaccgtaaattccaagatacgttaaccaataaagagttcaatgccatcctggttaaactggaagagaactatggcgaacgtgctcgtaaggcagaagccaacgaaggtattgactggaaagcattgagtcatgcatgtcgtggtggacttcaattattggaaatttacaaaaccggcgacctggtttacccactccaggatgctccatttattctcgatgttaagcttggtaaacatacgtttaaaactgtacaagaattcctagaagatatcgttgaccaagttgaacatgcgtcagaacaagcctctaagaacggtatgcaacaaaaagtagatatgagtttctgggatgatttccttgagcaagtctatctcgaaaatcataattcttactataaatagataaataaccattaacttgaggtaaatatgaaaaaattagtaattggtttattcgcagtaatgatggcattctctgttggtgctaccacgggcgcaggagctggtggtaaccagtcttctgggccttctaacggttcggtaaatgcatcacattctcagggtattgagaacattaaatcaagctatattaatagcacggccggacaagcaactgaagcatggtcaaagggtcgagtagttactcgctctgtattctgtgatatgcctaattatgttgctaagtgtgataagtaaatgtggggaccttcgggtccctttagggggttaaaatatttttaaaaagtggtgtacatgcttttaggatatgatactatagacctatcgaaacgaaatgagtaaattggagaataaaatgttcaacgttcaaatcaaaaaaggtatctatcgtaataacgaaatctctggttcttatgttgccacaaagacctggttcccggcaaagcttaatcctgaatgttcccacttaggtgatggtaaaattttcgttatgattgatggttctgaacgtggagtatgggtcttcaaatcagacatcgtaatggaaggagttgagacatcaccagttgcagttgttgaaagcactgaagatatgaaaactcgtatcaacaaacgctttaaagtaatgaacatgatgacgaatggcgttatcgatggtaaaattcgttcactcattatttcaggtgcagccggtattggtaagacgtattctctggataaagcacttaataatgctaatgataatggtttcatcaaatacaaaagcattaatggtaaaatctctggtattggcctttacgaacaactttggctcaaccgtgatgcagacagcgttctcttaatcgacgacgttgacgtattctcagatatggacatcttgaaccttcttaaagcagcattagataccggcgataaacgcaaagtttgttggagcactgcgtcatcttatctcgaggataagggtattgataaagaatttgagtttgaaggtactatcgttttcattacaaacgttgatatcgataaagagttagaacgtggttcgaaacttgctccacaccttcaagctttagtatctcgttcagtgtatctcgatcttggagtacactctaatgaagagattatggtccgagttgaagatgtaatattatctactgacatgatgcagaaacgtggtctgacggatgcagaaacgtataaagcattgtcctggatgaaggctaacgtatctcgtcttcgcaatgtatcattacgtacggctctttatgtagcagattttatttcaactgataaagatggttgggaagaaatctcggaagttactttactgaaataagcttataggaagttctgaggtaacaaaagccataaagatgaataatcatatggcttacctcaaagaaggacactaggaacctactgagggcatagaaatatttaaaataatgatgtacaaatcaaagaggatatgttatggattttatgcaaaaaattaaagccgcagtcgaactgtatgctcatcgtatggttagttctacgatgcaatatagcgaggaggttcgccaggactcttccttgaaaggaaaaactaaagccttaattaccttagatcgtttgcaaaagaatgccatagagatgctccagtacgacaagggtgtatataagaaagaacaggaagagaaacttaaatctgaaaaattacaaaaaatcccgaagtctgtttggttcagtggaaaaaatactgaaaaaagtttcttttagttgtttacaaggtctatggttatgttattatagacctatcaactactggaggtaaaacatgaacgctaaagatattttcaacctggtaaattataacgacggtaaatttaaatctgaagcacaaagcaagttctttaatgacgttgcttatggtaacgagattaccgtggacggaggtcagattttcaaatctcgctggaattggattgttatcatcgattcagttggaattgtggaagtctacaaaaacactaacaaaaaacgtacattattctggtctcgtgaaactaacgagcagtacaaaaaggataaagcatctcgtttatccaaagtaacccaggaagatatcgacttcatcaagaaagatatcgagatgtacgaaaatttaatcgctgaagaccaggcagtactcgataagtttgatgaaattaaagcttctcgtgaaatccctgacttcatgaaagaaacagtaaacgaacgatacgctctcacttcagaacgtattgcaaactatacaaaacagaaagcagaacgtattagtactcttcggaaatttgaagaacgtttaaagacggttcacgcataaacgctttacccaaggacgggttataatggttttgagttccaattcaatctgaggaaatagttatgagcattacatctgatgcggtaaaacatgaaattaacggtttatgtgcttcacagattaaagtgtggtttaaagaccataacgatcgcagagcacttaattatgaacaaattgctatccaagttcatcaattactggttagtaaatttgattttcatatgccgtctgaaatctatactaatctgccgcgagcacttattaaagcgtgtaaaggttatggaaaatcaatggctgatggaatcttcagcgcgctgaataaacttaacgttctgtcgatgattaactctaacaatatcctgcgtaatttaggacgtactgatttgttcggccgtgaacagtgtaaaatgcctttgaaatggattgttgctcatcttaacgagaaccaaacacgttttatggccgtaacagcacgtttacaaatgggcctagatcgtcagatgaactttaaaactcatccatgttattcaggttcaacaaacttttataaatgtgagcttcaaaaggtcggtggcaaaaccgtcttagtagttcgtgtaacgtttgaaggacgacgtcaaggatattttgacataatcggctccgggcttaaacattgtggatttatcgacgaagttgatatcaagcgagacggcattggataccgtattggatatgtttgtactcttaaagaagagatttcaggaccagctccaggactaaaagacgttagatataaagacgagctcgttgaagaaataaaagaagttgaatatgatatcaaccaagaagatgctcttaaagaccttattgatgaactgaaccaagacgttattccggttcagaaatttgaatcaaaacatgctgagcaaatcaaatactttgaagctttgattaacgaacttaatgtaactattcaacagactgacgatgaaatctcacgattagcaggcttaaatggtaaaaataaaacagaacgagctaatcttattcaagtagtaaaacttcttaaggaatgatgtacaaccaaggatggttggagtataatgaatttttcaacatgaggaatataaaatggcttttattacacgtagagaacttatcaaagaatttacctcgaacgcatatactccaggacctaatcctatccgtatgcctgtaaagactcctgaagagattgaggaaatctgttcatattatgggattacttctcgtaagtttactcaatttgaatgcgttactaacacacccgttaaagagttcattaaaaatggcgagttcagccgtttattggccaaacagaaacttcgtaatttttgtattggcggtgaaggacaatatttcgctaagcagttccggaataaccttaacaatctgatggccattgcttctcgtattcgtcctcaagcaattaacatgaaacatttgaaatatacttacgataagttggaaatcatggttatcagtgagaatgagttcactcttacgtataaacctaagaatgataacgttgctcgtgtattccaccaagcgttggaagttttaggtgataatatccaccagattaaagcaatttattctcgtgagcttaatattatcgaccctatcaagaataagggccatatcgctatccaggctcgtgtatctattggtaaaaaggttcctgcgccatggtggcacaaagactctgaatactatcaaaatcttaaaaaggaaaatgcattgtttgaagcatcgcttactgggaccccaattgaacaggccgaagtcctaagtgcttattctacttcgggtaaatcaatgtttaaaggtttgccaaatgtgtgcaaactgtctgcagtaaaactaaatgtttctaatgaccttcttccggtcgaagattaccattacaatcaaatcaaggccactatggaccaactgtctgttgaacttgacaaagcacaagctaagcttcgtgatgctcaaagtgttgtaacgaatctccagttgcagtattctaaactttttaacgcaatgaatgcattaaaatcataaaatagtttacaaccaaggatggttggagtataatgaatttatcttaacgagaggaaaatattatgacacgttcacattacattgaatactttgcaggtcttatcgctaacgttcatgcccaacgtgcttctggtgcactaggatttgatgttccacaccgagatgtagtaagtggtattcttcgagattttggtacatacataggccaagaaaatcatatctgtaaagatactcaaaatgcatattctcattcattagggacactgcttcaatggttcaaacgttctcgtttattatcttctactgtagctcgcgataacattaaaaactttatgaagccgagctttattaaatctgtgacatctaaaaccgatttggttgaattcactattgttaatgatgttaaaaagactcatttggctgattggttatctaccattcctgaaactaaatttgctgataaatttgcttgtgaattcaataaccaagtgaatatgctttttaaacattctcgtaaattattcacaggcggcgatgatcgtacaaatacagttcatgctaaagattgggttactgcagtgttcaaaccaaccggtaatggtaccgcatcattatcaattgatattcaggttccttattattactcacgtaatctcggcaccatgaaagctgaagaaattaagaagcacaataaaaccattcgttcgctgtcttataaacttcgcatgatgttaagaatcatggacgtggtagaaatgtatgatgaaaccgaagataatggttcaatgttatacagttctcgcattcaaattaagttgaagaaccctaacgagtataagcctaagcctattaaagagcctaaagcagaaaaagttgataacttaagagaagaacgcgaatatctcaaatctcgtctgaaagaagtcgaagcccagattgcagaacaaactaaatcgttaaaagctctgaatgcgaaagcggatggtttacgaaatgccattgaggtgttataatgaaactacgtcttttagaggatattgatatgagcactaatcatggcttggttaagtttattgacgatagttcaaagattgaatttgttcagcgagataaaatccacggtgaagaagagtttgttcctccggcatggaacgaaataatgaaaatggttgaacgacgtgaaaatgctgccaaatcggcagcaaaacatccatgcccggaatgtggaactatccaagtccaactggttaactggacaactgataacttgaaattgaaatgccgtaaatgcttccacaaatttgagagaacattataatgagatatagccttcgttgttttatcgcagctttagtttttgctattattccattcatttggaacagccagaatacttacatggaaactaaagtaattcctgtggaggtagtggaattaatctcaggccaatctacaggaaaatattctaaattagaatttattgcagtctataaagatgagcaaggacgagtttttgacaggcgtgtatcgccatcgttttatacgcttctgaataaaggtgatacgatagctatagaaattcgtgagatggatatcaaacaaactaccaaagataacttgatttggttctttggtacagtattgttggtttctatctgtatcacaggttttattacatgtattgtatttggcattgcatatttaatcgatgaaaggaaaaataatgtttaaattgtacgggtatgactctactattcataaatgcatttattgtgataatgcgaaacgattgctgactgttaagaaacaaccattcgaattcattaatgttatgccggaaaaaggtgtgttcgatgatgagaaaattactgagcttctggttaagcttggacgtgaatcacgagttggattgactatgcctcaggtgtttgctcctgacggaagtcacattggtggatttgaccaactacgagaatattttaaatgagtattgatttaactttccctggcccttatgaccagggtgaattagaagctttattatatcaagaaatgtgctctcgtgccaagaacgatattcagtatgctatcgataatccatggggcgaatttcgagtaatgatgggtaatcgaatcatcggcgtccaatggcgattcgttggccttgagcctgaggactatgaagaaaacgagcacggtgactggattcctgttggtgaatatcactgggaatacggtggtcctgattttgaagtctcttgttcatgggtagaacaataacctgcgagaaaattttaaatgacatattcattaaatcttaaagatttccaagatgtatacaaagtttgtgccaatgaacttggtcctgatgctccaactattattgaagttttaaatgtgctcccttcatcattagcttacgaagccaaatcatggggatggaacgacactgtcgttcgtgatgacctttacgtcctgatgaacgacatgatggttaaaaaggcagaacctgttgcaccaatggttaccattaccgttgaagaatataatcgcctgcaagccattgaagagcttctgtggaacattgaatgtgacctgccgtcagggctagaatcctggattgattatgaagagctcaataaactctggggttaagccatggtattcggctcgatgggagacagtcgagccagacgtcgaaacagtttacaacgacgaagaaacgtgttatgatgaaccttcaataaatgaattaattgatatggagatgggaagagattattatgcaagttaaattattgtaccgtttattaaaaaatggcaagcatgattggtatttgcttattaaaaccgatccgaattttttctctggacaaccatttacagttcgtcctactaaacgtcagcttcgcaaagctaaacgttctcatcgtaacttttatagagaatattgatatgaatatttctgaaactcgcggtaaatggttcaagattgttaaagaagatgaagaactacaagtcaagtttcctgaattaaagaaagatacgatcatcaaggtaattggtactactaccgaagatggttatggcgaccatggcattattgaagtgatgttgaacacaggtgagaaactttgcatctatgaccgtgatacttctctttggtgcttctgggaatcccattcaatagatgaactcgaagaaattgaccaagtagtttgtgatggtggacttggcgaattcgaaggtgaacgtatttcttatgctttagctaaattagccgcccaagaaaataatgacggttatgaaggtaatctgatgcaagccgcagcggaatacattgaatatttagaaagacgtttaagttaaaggtttattatgaaaactgaactattttatggcgaaagaacaaacggccaaaaatcctggaaatttattatgattggggctccaaacaatccgaacatgaggacttcaatcatttcggtaacacgtcctactaaaagaatgattcgacagtataaacgttttcatcgagacttttataacgtttactaaattataaatacccttatctatatatggtaagggtttattatgttattatctggcaaattatacaaagaagaaaaacaaaaattttatgatgcacagaacggtaagtgtcctatttgccaccgtgaattagaccctgatgttcaaggtaaccatcttgaccacgaccacgaattaaacgggccaaaagcaggtagagttcgtgggttactctgtaatctgtgcaacgcagcagaaggccaaatgaagcataagttcaaccgttctggtcttaaaggtcgtgatgtcgactacctcgaatggcttgaatctcttcttgcttatttgaaacaagattattctgataataatatccatcctaattttgttccagacaaaactaaagagttctcaagactaggtaaagaggaaatgatgtccgagatgcttcaaagaggatttgaatataatgaatctgatactaaaacacaattaatagcttcattcaaaaagcagcttagaaagagtttaaaatgaaaattgaaaaagaaattgaaggattaatttataaaactaataaagatcttttgaacgagaatgctaataaagattctcgtgtttttccaactcaacgggaccttatggctggtattgtgtctaaacacattgccaaaaatatggtcccgtcttttattatgaatgcgcatgaaagcggaatcattcacatgcatgatattgattattctcctgctcttccgtttaccaattgctgtttagtcgatttaaaggggatgcttgagaatggatttaaattaggcaatgctcaaattgaaacgcctaaatctattggtgttgctactgcaattatggcacaaattaccgcacaagttgcttcacaccagtatggcggaactacatttgcgaatgtagataaagttctttctccttatgttaaacgcacatacgctaaacatgttgaagatgcagaaaaatggcaaatcgctgatgcgttgaattatgctcaatctaaaacagaaaaagatgtctatgacgcattccaagcttatgaatacgaagtaaatactctctttagttcaaacggacaaacgccttttgtaacaattacatttggtacgggaactgactggactgaacgaatgattcagaaggcaattcttaaaaaccgcattaaaggtcttggtcgtgatggaataactcctatttttcctaaacttgttatgtttgttgaagaaggtgttaatctttataaagatgatccaaactatgatattaaacaacttgcgttagaatgtgcaagcaaaagaatgtatcctgacattatttcggttaagaataataaagctattaccggttcttcagttcctgtttctccaatgggctgccgtagtttcttgagtgtatggaaagattcgactggcaatgaaattcttgatggacgtaataatcttggtgttgtaacactgaatcttcctcgtatcgcattagattcttatattggaacccagttcaatgaacagaaatttgttgaattattcaatgaacgaatggatttatgttttgaagcattgatgtgcagaattagttccttaaaaggagttaaagcgactgttgctcctattctttaccaagaaggtgcattcggggttcgtcttaaacctgatgacgacataattgagttatttaaaaatggtagaagttcagtgtctttaggatacattggtattcacgaattgaatattcttgtcggtcgtgatattgggcaagaaattttaactaaaatgaatgctcatcttaagcagtggactgaaagaactggttttgcttttagtttgtattctactcctgctgaaaacctttgttatcgcttctgtaaactcgatacagaaaaatatggaagtgtaaaagatgttaccgataaaggctggtacactaacagtttccacgtttcagtagaagaaaatattactccgtttgaaaagatttctcgtgaagcgccatatcatttcattgcgacaggtggtcacatttcttatgttgaacttcctgatatgaaaaataacttaaaaggacttgaggccgtgtgggattatgctgcacaacatttagattattttggtgttaatatgccagtagataaatgttttacatgtggaagtacccatgaaatgactcctactgaaaacggatttgtttgttctatctgtggagaaactgatcctaaaaagatgaacaccataagaagaacatgcggttatttgggaaatccgaacgaacgcggatttaatctcggtaaaaataaagaaatcatgcatagggttaaacaccaatgaattatgatagattttatccttgcgattttgtgaatggccctggttgcagggtcgttcttttcgttacaggttgtttgcataaatgtgaagggtgttataataaatcaacatggaatgctagaaatggtattccattcactggagagacactagaacaattgattgaatgtttgaataatgattatatagaaggattaactataaccggaggagaccctctctatcctgataaccgagatgttattcatcgcattgctcaaacagtaaaaaatctttatcccaataaaagcatttggttgtggacaggatataagtttgaagatattaaacaactagaaatgcttaaatatgttgatgttattattgatgggaagtatgagaaaaatcttccgactaaaaagctgtggcgaggatcagataatcagcgactttggtcaaataccgatggggtgtggaaacatgattaaattgaattacattatggatactataaatgatatgatttttcgttttggtccagaattttattcgcaatatagtttaatgattatcaatgcttagttaattaagggtaaatatgtacaaatttcgtaaaggtttagctgattttcttacaactgtaacgttctttttgtttatggcagttggagctatttttcttattccttttactggtgtatttttcgtgattagtttaatttctccagaaaagggtttatcctccaacgaattcaatgaacgtttggacaaaattactaataaactgaattctgttcttgataaaaaggcttaattatgattagttttgagcggtatgtagtagagagttggaatggttttgatatgttcggtaatgactattatttctatgaatgtagtctgaacccaagcttctgggctggacgtgaacaagacctcgaagaaatcaacgctcgtgccgatttgttaggtgaactgcctacggtttattttacctttgatgaatccggcttcgttatccaggtttattttcctgaagaaaactctggtgaggattctgttaatcctccttattgggcttaccaaggaattatttctcgtggaacaaaactcgaacttaaagaacaagattgaaatttatggcatccctgaagaagttggacgttgtccaggatgttatactgttacaaaacttttaaaggagctcaatgctccttatacattttataaagtcctcactaataatggtaagattgaatatgaccgtcctttaatcgtatctcttgctaaacgtgcaggattcacttcacttaatattcgttatcctgtcatatttttaaatgataagaaacaaaagaatattgcagagtttaaaaagtccttgatttcattaggatatgactctgatatcatagaagattgaccaggtgccgcctggtcttctttatctcatttctaatataatccattggaatcttcacttcactatctccttgtgcccctctcaaatcaaaaaatattttcataaaacagtttacatcctcgatagatatgttaagattaacaccatctaccgcagaggaaaacaaaatgacaattgaagataaagaaattaaggttgaccagtactattctgtcaatggtaatgccatacagataaccagagtttcaagcctggatgtttggtaccgttcaatcaaatatccagaaattggtgaaatgctttgtgaccgtggtatcttctgttcaattgcgaaggaaattaagtcatgattagtttagattcaaagaaagttgttctaacccttaaagttaatgacgaacgtccggtattcgttaccatttctgatttgcatgttgaaattgctaatggcgttcgtacttatcaagcaaataaaactcattgggattatatcccgatgttgacgcttactcagcgtttagaatcaatcggtcttaaagacctttcagtaagtgaagtgaattttatcaaacgcgttgtatcaatcaacctctgaggtacttatgggtaaaacgtatcgtcgtaaagatttgaaagttcgcgattacgactattttggtaagcgtaaagctcctgacggtgttagccacaaagacatggttgaaaacatcttccgctcagataaatggaaacgtatgaaaggcgttgattctgaagtcaagaatgaaatgaatcgacaactccgcaaagaagttcgtaagttgaaaaaagatgtttacagtaaagaagagtatgattataatacttctcatactgaagccaaacgtaaagctaacgaatgttatcgttacagttgaggaaattatgaatatcaaacgaatgctttttaagcagggattatatactttaaatgttaatccaaagggtgatacaactaaatggtctgtaaatgactggattaagttcatcgatgaaaatggggcctggaacacaaaatgaatcctgaatctatgttatcgcaaaagcttcgtgaagaacgtgccgaattctttgccaatatgaaactcaacggcgttgaggatgaagacttcttacgctggttctggatttacaaatacaaagaatgccagcacgctgtactactgacttgtgcagttatgtacgaaggctggaaaggcgctaaaaagttcggttaataatgtacaacgataggaagacatgttattatcttcctatcgtcttaaaatgaggaaaatatcatggcccaagaattagattttatcaaattcaaaaaacacctcgacgttaaaattggggattcaattgttaggattgagtatgacattttaacagatgctattactgttagttgtgatggaaatagtttcagcttcgatacaaccgaaaacaaatacccaatctataaaggcatctttgatatgggtgttgatattactccacgtgatacaaattacttacttttcatgcttaaaaaatagtatacaaactcttgagagcagagtataattctctcgttggataataaaataaccgaggaaaataatatgtctactaaaatcaaaaacgtagttaattctttcgctttcgataaagttgttgctcttctggaatctggcaatattgttactcctcaagttcttgatgcgtgggaattccgtctttatgaaatcatgcaaaaacacgaccagaaaattggacgtaattctattcgtgaaattctagtacaatatattctttctgaatttgacgttgctgcatttggtgttgaatctaaagcttatcagaaacatgaaatctctgaaaagactatccgtcgtatgaaaaatcaacgtaagaaaaaattcgttgaccttaaaattgttaaggcggtaaaatgagcgtattaacagaaactttgattaatgacctgcgtctagctggttacgaagttggtacaaatagtctaggtcttcctcagattgaaggtcctggatttattctagaatacgaattcaaacaatggtggttatatgctactgttgacgatgcgttgaatattgatttcgttgaccaatttgattcgctggatgctgctcttgaagcagcaaaggaactagaatgaaattaactcgaatcagtataactgaagaaaagctgggcgaattttatgttgacgaatacatgaaagtcacgtattttccattcgttaaaggtgttggtttttgggaaactcatgtatctcaattaaacgaaggcgactataacgaaacacatgagaactttttagattttctttataatgccggtcttactgagctttatatcgatatccatgagttcaaacgtttaatggaaaaagtgtttcaggcttattgtttgctccgatagtatctcgtgctttaagataggtctctaaatattatgatataatagacctatgaattgagccaagaggtacttatgactgaacaaaaacctaaaaataactatgtgaataataaagagcttctcgccgctataatcgagtggaaaaaggagctcttaaataataaagacccaaacaaaattattcgtcagaatgataccatcggtttagcaattatgcttatcgccgaaggcctgtccaaacgtttcaacttttcaggatatacccagtcttggaagcaggagatgattgcagatgggattgaagcctctattaagggacttcataatttcgacgaaactaagtacaataacccacatgcatacataactcgagcttgttttaatgcttttgtccaacgtatcaaaaaagaacgtaaggaagttgcaaagaaatatagttacttcgttcataatgtctacgacagtcatgacgatgatatggtagcgttggtagatgaaacgtttattcaagacatctacgataaaatgacgcattatgaagaatccgcttataaagctcctggggctgaaaagaaggaagttgttagcgattcgcctagtttggattttttatatgaggatgacaattgacatctctaactacttagaagaaccttttgacgaagcaatcccttatttggtaaaactgttgggtcgtgaatttaaaattaattttgacatcgaccctttgaaccctcatgacgtgtcattttcgataaacgggactccagttgaatatgagttctgtattgaagaggatggacgtttttattttaatttaatgagataatatgactaccgagattattgaaaataaagaagcagaagatgcagtagctaaaatgttacaagaaatccaaaagaaaaatgaagctgaagcacgtaaaaaatccgaaaagattcttaaaaagaatcgttttgaactaaaccgtctttatgctcatgctcaagaagcagcaattcaaaacaacttcgaagcttacgaatatgctattaagaaatctcgggatattctacgacaaccatacaatgacaagttaattaaaatccagtgggttactactcgtcaggctattgaggacatcattaatggcgctagttcaaacaaagtttaaacgtctgaagctgaacgcagggttcacccttaaattgggaggtcctctttgtgttaaaatttctgaaaaggaatatcacgacggttctattacagaaatttgtccgcctattgtaaaggcagacccaaaacaactcgtgtgggtcgattcatttcaagttaagaaatggtggaaacgatgagagaaatcgatttaggtattttctgagaggtgcttatgcatgacgaacatcccgacttctgaaaatttcgataaaatccgtaaaggcaaagcagaaagaatgagacgttttaaagagtcttatgataaagctaaagccgaaggaactattacgtacaagcccattcgatttaaaagttcaaatgagcctctgtacggtgtactatgtggataggaactcttcggagttccttttttgctttataaatggatgataaaatgaattaactaatgaggaaataatatgaaaattttgcacttaggcgacttccatatcggagtcaaacaagacgacccatgggttcaagatattcaacgtgatggtattcgtcaagcaattgaatactctaagaaacacgggattaaaacttggattcagtacggtgattggtttgacgtccgtaaagcaataacacatcgtacaatggaattcaatcgtgaaatcgttgatatgatttctaaagcaggcattcacgttcatgtcacgataggaaaccatgacatggcgtttaagaatacaataacacctaacactgtttctgaattgttaactcaatttgaaaactttactatttacgagcatccaactactgtggattttgacggatgtctgattgatatcgttccatggatgtgtgaagaaaatacaggtgaaatcttagagcacatcaagacttcttccgcagcgtattgtgttgggcactgggaactgaatggcttttatttctataaaggaatgaagtctcatgggcttgaacctgatttcttaaagacctataaacaagtctggtccggccacttccacacaatctctgaagctgctaacgtcaaatatattgggacaccatggacccttactgcaggcgatgagaacgacccgcgcggattctgggtatttgacactgatgttgaacgtatggaatttattcctaatgaaacaacatggcatcgacgaatcacttatccgtttaaaggcaaaatcaattattctgattatactaatctagccgtacgtgttatagtatcagaaattgattcagagttgactaagtttgaatctgaacttgaaaaagtagttcactctcttcgtatggtttctaaagttgataacagcgttgaatctgatgatgaccaggaaatcgagattaaatcacttcaagatatcattaaagaatatattgacgcgattccagatatctcagacgaagacagagaagcgctggtcaaatattccaacgaactttatattgaggcaacacaatgactttagatgaatttaacaatgctgggctcgggcttgaagttgaaatagacgttaaagatgatgatggattcgagaacaccatcaagtattggattgagccattacgcgttgaaggcaatgaagttaaagcagttcatgtctgcaccgactgggctattgaatttagctttaatataatggacaacgatactcccggctctattcttaaaatggctgaagcgtgtattgaggatgcgtataatgacgaagactgattatgaaatccatcgtcatgaatttagtattggtgacggttatattggcatcgttgaatggactgagaattacgaggaatcaactcctcgtttctttggaacaatgtatgttacttgcgagtatgcaccaggtgttgttatgtatgcggaactagatgaatattttgctgatagagatgacatgttaaaatatgtagaggacttcattcgaagagaatacatatgaaatcatttaaattaaatcgtgttcgttatcaaaacatcatgtcggtaggtgggaatcctattgatatccaattagataaagtccaaaagacattaatcactggtaaaaatggcggtggtaaatctacgatgttagaagccattactttcggacttttcggtaaaccatttcgtgatgttaagaaaggacaaatcattaatagcacgaacaagaaagagctcttagttgagctttggatggaattcgatgataaaaaatacttcattagacgcggccaaaagcccaatattttcgaaatctccgttgacggtgttcgtctcgatgaatctgccagcagtcgtgacttccaagaagaatttgaacgtagcatcggaatgtcatacgcgtcttttaaacagatcgttgtgcttgggacggcagggtatacccctttcatggctcttagcacccctgctcgtagaaaacttgtcgaagaccttttagaagtcggcacactcgctgaaatggataaaatcaataagtctcaagttcgcgaacttaattctcagggacaagttcttgatgccaagaaagatggtattatccaacaaattaagatttataacgagaatatcgaacgtcaaaagaaattatctggtgataatgtagcgcgtctacagaatatgtatgacgacctagccaaagaagctcgttcattaaaagcagaaatcgaagaagctaatgagcgactacttaatatcgttcttgatgaagaccctactgaggcattcaacaagataggacaagaagcattcttgattaaatctaaaattgactcatataacaaagttattaagatgtatcatgatggcggcacatgtcctacttgtgcatcacaattgcaccagggtgaccctattgtctctaagattactgataagcttcatgaatgtaatcactcattcgagcaacttacatgtcacagagataacctgagtgtcctagtggacgaatatagagctaatgttaagactaaacaggaccttgcatctgatattcgtaccaagaaacaagcaatgattgccactattgataaagctaagaaagttaaagctgcaatagaacaagcctcggcggaatttatcgaccatgccgatgagatagctttgcttcaaaaagaacttgataaaatcattaaaacaaaatcagatatcgttcttgaaaaataccatcgtggtattatcacagatatgttaaaagattctggtattaaaggtgctatcattaaaaaatatgtgcctctgttcaacaagcagattaaccattatcttaaaattatggaagctgattacgtgttttctattgacgaagaattcaatgaatctataaaatcacgtggtcgtgaagattttagttatgcttcatttagtcaaggtgaaaaagcacgcattgatatcgcgttgttgtttacatggcgagatattgctgaaaaggtctctggtgttagaatcaatacattaattatggacgaagtcatggattccgcgactgattctgaaggtattaaagctatttcaacaattcttaactctctaaccgatgcaaacgtgtttataattagtcacagagaccatgacccacaagcttatggacaacatttgcaaatgagcaaagttggacgatttactgtaatgactgtttcataaacgctttaacacgatgtggttataatgaccacatcaaattaaatggagaacaacatggagtattcaactggacaacatcttctcgttgtccctgaaattaaaaaatatgttttgaccaatacgttttcaggtgaagaacatattgttactgaacaaatgctcaaatctgcttttaaagatgagtataataaaataatgtctaatcgcaattccgcatggacagttaccgacttctacgaataagagagaaataatatgtttactactgctaaaggtttcactgctgctgatctgaaagttacttctatccgtactgacgctaacccacataaccataatcgtgttcgtaaagcatgggtcctgcattgtgatgacgcaagtgctaaaaaactccaatctttgccacaagaaactcgttttatgatttatggttttattgataatgatgtatctgatatgtggattcatctgatgcgtaagcactataaagattctattgaagctggcgcaaaaatcgttcttgataaagacggttctgagcgtctggaagatttctactgtgttgatgccgacgaacaactaattgcagctggcgaaattgttgcttctaaaattccagaatatattgaatcactgcctgaagctattaaaaagcagatggttgctgcataataaatttgttataaactttgaattgtcttgaaaggaaataaaatgaaactgtctaaagatactatcgctattctgaaaaactttgcctctattaactctggcattctgctgagtcaaggtaaatttattatgactcgtgcagttaatggcaccacttatgcggaagcaaatatctctgatgaaattgattttgacgtagcactttatgatttgaatagcttcttaagcattttgagtctagtgtctgatgatgctgaaatttcaatgcacactgatggcaatattaaaattgcagatacacgttccacagtttattggcctgccgctgacaagagcaccattgtttttcctaataagccaattcaattcccagtggcttctgtgattactgaaattaaagccgaagaccttcaacaattgcttcgagtttcacgtggtcttcagattgatacaattgctattacaaataaagatggtaaaattgttatcaatggctataataaagttgaagattctggactaactcgtcctaagtattctttgactcttaccgattatgatggttctaacaactttaacttcgtaatcaatatggctaatatgaaaatccagccaggtaactataaagtaatgttgtggggagctggtgataaagttgcagctaagtttgaaagctctcaagtaagttatgttattgcgatggaagccgattctactcacgacttctaagtcaaagctttacgtttattgtgatacgattatggaggagaaatcctccagtttaatgataatgaggaaaattacatgattactatcaattccaaagaacacattctagaacagaaatatcgtccttcttccattgacgaatgtattctgcctgcgtatgaccatgaaacattcaagtctttagtatctaaaggaaaacttcctcatattattttacactctccatctcctggtacaggtaaaacaaccgtagcaaaagcattatgtaatgatatcaatgccgaaatgatgttcgtcaacggttctgattgtaagattgattttgtgcgtggtccgttaactgcattcgctcgttcagtctcaatggaaggcaagcctaaagttattgttattgatgaatttgaccgtagtggcctcgccgaatcacaacgtcaccttcgtacattcatggaagaattctctagtaactgttctattattattactgccaacaacatcgatggaattatcgaaccgttacgtagtcgttgtcgagttatcgaattcggacgtccaaccgaagaagataaaatctcaatgatgaagaaaatgattcatcgcatggttgaaatctgtaagaacgaaaatatcgaaatcgctgatatgaaagttgttgcagctctggttaaaaagaacttcccggactttcgacgtacaattggtcaattagaccagtactcgtctaaaggtgttcttgatgcaggtattttgtcgattgtaaccaatgatcgtggcacggtagatgatgtcatagaagcaatgaaaaataaagatatcaaacagcttcgtgcgttagctccaaaatatgccgctgattattcatggttcatcgataaattagtttctgagtgttatgacaaagttgcaccaggtaaaagtattatttcgctttatgaaattgcaggcgaaaataataagtttcatggattagcaagtaatattgaattacatgttatgtatatgcttcttcaactgacctgcgaactgacttggaaataatatgaacttatttgatgatgacgtccggcttaacgagcaccaaattgcatggaagtctaacgacgctgatgcgattcaaaaatgtgctgacatgtttaaagaaaaacctgagaatgaattctttaaaatcattaatgctattaatgaaaagaaatctatgtcaattgctcaggtcgactactcaaaatttatggttgagaactcattatcccagttcccagaatgtatgccagctgtttacatgatgaacttagtcggttctgaattaagtgatgaagcacacttcaactatatgatggcggcaattccacgtggccgacgattctctaaatgggctaaactagtcgaagacacttcagagttactagttatcaaactgttgatgaaacattacacaatcaacatgaatgatgctaccgagtataagcggctccttgaaaaaaataacaagttgccaatagtccttaaagaactgaaggccatggtcactgatgagtttctcaaagaagttacaaaaaatgtgaaagaacaaaaacaatttaaaaaattagcattggaatggtaaaaatgattgaaattaaattgaagaaccctgaagattttctgaaagtcaaagagactttgacccgtatgggcatcgctaataacaaggataaagttctttatcagtcctgtcatatcctccaaaagcaaggtaaatactacatcgtccactttaaagaaatgttgcgtatggatggacgtcaggttgatattgatggtgaagactatcagcgacgtgattcgattgctcagttgcttgaagactggggcttgattgttattgaagactctgctcgtgaagatctgtttggccttactaataacttccgtgttatctcttttaaacagaaagatgactggactttgaaagcaaaatatacaattggtaattaaagcaatgggacttcggtcccatttggagtataataagttcatcaacaaacaaaagacaataactcgtctaaaggaaattaaatgaaagaattttacttaacggttgaacagattggtgattcaatttttgaacgttacatcgattctaatggccgtgaacgtactcgtgaagtagaatataaaccatcactgtttgctcattgtccagaaagtcaggctacgaaatatttcgatatctacggtaagccgtgtactcgtaagttgttcgctaatatgcgtgatgcctcccaatggattaaacgcatggaagatatcggacttgaagcacttggcatggacgatttcaaattggcgtatttgtctgacacttataactatgaaatcaaatacgaccatacaaaaattcgtgtggctaacttcgacatcgaagtaacatctccggatgggttccctgagccgtcacaagcaaaacatccgattgatgctatcacccattatgactcaattgacgacaggttctatgtatttgatctattgaattctccgtatggtaatgtagaagaatggtctattgaaatcgctgctaagcttcaagaacaaggcggtgatgaagttccatctgaaattatcgataaaatcatttatatgccgttcgataacgaaaaagaattgttgatggaatatctcaacttctggcaacagaaaactcctgtcattttgactggatggaacgttgagtcatttgatattccatatgtgtataaccgaatcaagaatatttttggcgaatctactgcgaaacgtttatcaccacatcgtaaaactcgtgttaaagttatcgaaaacatgtatggttctcgtgaaatcattacattgttcggtatctctgttcttgattacattgacctttacaaaaaattctcttttaccaatcaaccgtcgtattctctggattacatttcagaatttgaattgaacgttggtaaactgaaatatgacggccctatttctaagcttcgtgaaagcaatcaccaacgatatatttcttataacattatcgatgtgtatcgtgtattgcaaattgatgctaagcgtcagttcatcaacttgagtttggacatgggttattatgctaagatacagattcaatctgtgtttagcccaattaaaacatgggatgctattatttttaatagccttaaagagcagaacaaggtgattccacaaggtcgttctcacccggttcaaccttatcctggcgcttttgttaaggaacctattccaaatcgatacaaatatgtaatgagtttcgaccttacatctctgtatccaagtattattcgccaagtgaatattagcccggaaacaatagcaggaacgtttaaagtagctccactgcatgattatattaacgcaatcgctgaacgtccttcagatgtgtacagttgttctcctaacggcatgatgtattataaagaccgtgatggtgtagttccaactgaaatcactaaggtctttaatcaacgtaaagaacataaaggttacatgcttgcagctcaacgtaatggtgaaataattaaagaggcattgcataatcctaatctttctgttgacgaaccattagatgttgattatcgttttgacttcactgacgagattaaagaaaagattaaaaagttgtctgctaaatctcttaatgaaatgttgtttagagctcaacgtactgaagttgcaggtatgactgcacaaattaaccgtaaattgctcatcaactcgctttatggtgcacttggaaacgtttggttccgttattatgatttgcgtaatgctactgcaatcacaacattcgggcaaatggctttacagtggattgaacgtaaagttaatgaatatctgaatgaagtttgtggtacagaaggtgaagctttcgttctatatggtgatacagactctatttacgtatctgctgataaaattatcgataaggttggtgaatctaaattccgtgataccaaccattgggtagacttcttagataagttcgctcgtgaacgtatggaaccagctattgataaaggtttccgtgaaatgtgtgaatacatgaacaataaacaacacttaatgttcatggaccgagaagctatcgctggtcctccgcttggttctaaaggtattggcggattttggactggtaagaaacgttatgcattaaacgtgtgggatatggaaggtactcgttacgctgagcctaaactcaaaatcatgggtctagaaactcagaaatcttcgacccctaaagcagtacagaaagctcttaaagaatgtattcgtcgtatgcttcaagaaggtgaagaatcattacaagaatattttaaagagtttgaaaaagaattccgtcaattgaattatattagcatcgcatcggtatcttctgcgaataacattgctaaatacgacgtaggtggattcccgggtcctaaatgcccgttccatattcgtggaattctgacatataaccgagctatcaaaggtaatatcgatgcaccacaagttgtagaaggtgaaaaagtatatgttctgcctttacgtgaaggaaacccattcggtgataaatgtatcgcatggccttctggtactgaaatcacagatttaattaaagacgatgtacttcattggatggactacactgttctccttgagaagacatttattaaaccacttgaaggattcacatcagcagcgaaactcgattacgagaagaaagcatctctgttcgatatgtttgatttttgatataatgccaaggacggccaactaattaaatgagagaaatatgaaaactactcctattactatcgctattgacgcaatcgtaaaacaagcttcatctcttgccactatggctaaagtaattagtcaaaaccctgctcgttataatgctattctagaaactcttcgacgccctggacttagtaattatgaaagccgggtaattattacaggtgttggtaagaatgctaatatcgcaactaaagcttctgagacatttgcttcactaggtatcccaagtatgtacttgaacactgggcattattctcatggtgacgcaggatttattgcacctaatgatgtattagttcacatcagtcgttctggtaagactgaagaaatgataggtgttgctaaacatcttcgtatgattcgtcctcaggttaaacaaattctgttacattgtaaccctgacattccacaagaatacgaagctctttttgattatacgttctgtaccggtatcgcggtagaagttgacgagaactctttagctccgacaatgtctactacattgttgttagcgcttatcgatacgttcgctatcaacctttcgtctgaacgtggatttacctctaatgatttccttaagttccatccgggcggtgcactaggtgccatgttacgaggcgaacaatgaaagcaataacaataggacttttactattgatgcttgtcatgactatctactggagcttaacggctccggtaatgattccaacacttgtaattggatggattatgattggactacaagcaaagtatgaatgctttaactagaatagtgtacaatactcctacttaccaatgaggacttcaacatgaaaaaagctgttattcttggtgctggactggcaactcgtttatatccaataacgcatcatattcctaaggtgcttgttaactataaacaagacactattctgagcaatttgtatacaatttattctgaccttggcgcagatgaaattatcgtagtagttcattcaaaatttgctgaaactgttcgagcttattgtgagcaagaagggttcaatgtgactattcgtacagttgatgaagcatacggttctgcttatgctcttgctaaattacacaaagatttagacggccataacgtaattgttaactggtgtgatattattcccgattttggttcatggtcttggaatgttaacgcaatctatgttaagggtgatgaatgtcggtataatttcgatggtgaaaatatcactaatgtaggtgaaacaggcggtaatgttgtgggaatttaccagttcaaagactgggaattctacatgggttctactgatgaggaaattcatgaatactgcaaaggacgtgatttcgtagaattcctttacagcggcgcattcaataaatcagagcttatgaatatcatcgaccttggtgatatgcctaaacttgaaaaggctcatgaagttcgtgaacttaatcgtagttttaatgcagttgaaattggtgaagaaactgtaactaaattcgcattaaccgaacagggtcgagctcttcagaaagatgagatttcatggtatcttaaagtgaaatcggattcagttcctcagttagtttctgttaatgaaaataactttgaaatggaacgcattaaaggtaagccggcatttgaatatattaaatccaaatcaagtcttgctcgtccacaaattgttgatgcaattttagatgcactgaaattcagcacagacacttattttgtaagtcctgaaactgttcgtcgtgatttcactaaagaattctatacgaaagttattgatcgttgtgaaagcattcaaccattgattgattcatttggtaaaatcacacatgtgaactacactaagattggacgtctgaagccaatgctgaaacaagctttagaacaccttattcgttatcataaccgttctcagggacagtactctgttattcatggcgacccgaacttcagtaatactatgattactgataacggcgaagtcaagtttatcgaccctcgtggatattttggcgaaaccaagatttacgggccaaaattgtatgatgaagctaaagtgctttatgctgtttcaggttatgatgaattcaatgctaatccgacctggggacagtttactattgatgaaacaacttgtaatgtgactattaacatcaatccattagtttacaaatatggaaagatgagttcgtttaacgagtatcatcatttggcagtggcaattatctggattgcattaggtggttatttcaagaataatccacttaaagcggtagccgcatattataaaggtatggaacttctgactaagcaattacgtaacatgggccgtgtacttcaggacggctctattagttatgacgtagcagaacctgtaacggctactctgattacaaaaaatcctggtaaatgggtactaactgataaagaaactggtgtttcttatcgtccaatcggtggcgatatcactcatcaatgggaacgaatctaatgcaccgtgtagaaaacatgcttaatctttgttttgatgtcgatgattgcatcacggaatggaataacaatcgtgattacgtgaacttcaaaccagacgtcgaaatggtgtctgccattaatgccctgtatgatgcagggcataccataacgctttacactgctcgtggtatgaagtcagtaggtcctggtcgtatagcaattgacattctcccaagtctgattcagaacttggaaaacattggcttgaagtaccataatttgctaacacataaaccagtatatgattggattatcgacgacaaagctatgcgtcctgacgaattcaaagctcttatgaataaaggcgaattcgaaacatttaaatcatataaaccgaatctataataatttaagtaagacctgcaaaaaaccatcgcatcaattaacgcgagatgcaaaaaaaatgaatacttttaaaatcggaacgaattttgatttagctcttcttgataaaatcgtagagctcaataaaacttatcctaatagcttgataaatgaagtatacggctctacaagagaaatggcttttgtagcagccagacctgattttaggcttcctgacgttgacaaaaaaatgttagaagactacgttaaacgttgtaacgaattaggtatttgctttaactatacactcaacacgataaatcctggttcaaaaagagaactagttgagtggaagaagaaagctattcaggattatgttcagtatctttggtcaataggcgtatggcgtattactatcgctaaccctgttgttatggaaattgttcgtgaagtcaataaagatattgagattgaagtttcaacaattctacatgtcgatgctgtaactcaaatcaaatacttgcatgaccaatataacatcaaaaaggtctgttgcggaattcataagaaccgttcagtttctttcctgaagcgtgcagcagagttttgcaataagaacaatataatatttgaagttcttgtaaatgagttctgttctaatgctggtaaagggtatacaacacattgtagctatcgtgactcttgctatattttccatagtactgatgttacagctgatgatgctaaatccttaaacggatatcctatgcagcactgtattaaagctcgtgatacagacccatttaactggttgagaactcgttttgttcgtcctcaagatttgaaactttataatgatattggtatcactcaattcaaagtttcaggacgtacaggtagcacagactacattttgaaagttcttgaagcatacgcttctgaaaagtttgaaggtaatttgttagaactgtggaagcctttagagactattttcactcttgaaaacgaaactgagttttcacatacagtaaatattgaaacctctttgttagatggctttttagaaaaaaggtggttcagacatccagatttcgattgtgctaatgaaatctgcgggacgacgtgtacatattgtgaaagatattataaacgtcaattatctaaaaacgggttagcagaaaactctatatctattattgatataactaactctgatgacgctttgaggtacccggaatgatttctagaaaaacttttaaccaccaacttaatgaagagattttgactatgaaactgaacactaatgaacaaattcttaaaaaggccctgatgggcctgtttgaaactaaagcggctaaagtgattaaagaacctgttcaattggaatactacgctgatgcatttcttcatagtgttcttggaagtatcgatgctgaagctttacgttatatcaacattgccaagaaattcaaataagctttacgaattgagtatataataattgtattgaggtaaacatgggaaaacataacacaatgaaatatatcaaagccgcagattttcaaaccgcatttaaagcagtcaatcgtgaaattttagaaaacccggaattcgtaactgattctcgtattggacgttgtaatgaaattgggtctatgacagtagttgttgacactccatcatcattcaaaatgaccgacccacgtattaaccgcatctcttatgaatatgccgaagacttctggaagtttatgatttctggtggtaccaacgcagaagaagcgtttaaggcatatcctaatgtcgctaaatttatttctaaaccaaaatcagatgttttgccggcgaacttcaacactttctatggtcctcgcattgcggctcaattaccagctcttctaaaagaacttaaagagaagcctaactctcgaagagttgtgttccaaattctagaaagttctgatcaggctttgcttgattcggacgaaacgcttgaatatccatgtactgactcagtgacttattatattcgtgatggtaagctttatacccactgtcatatgcgttctcagaactgtgctgttgttatgcagttggatttttatctccaaggaaaattacttcattatatcgctaacgaatgtggtgtagaagttggtgattatactcataccatggtaagtgcccatgtgtttgaacgtgattttgattatgttaaaggattccttgactaatggctattttccgcgtacctatcttgagtatgaggtcttatgaaactggacagtatgctatccttaaggatggcaacttccaacttcatttgcaccgtgctaatccgggtgatgtgattacatatccacgtaatgcatctgatattaaagaatgcgaacgtctttttccagaatttaagtttgttccattatggtataaagataacgcgtataacactcgtaaatatttctggtctgaaaatgaatttgtggttgattcattaattgcttattatgattgtgattttctaatcacagatatcactggatatgacggcgcttttgatgtggaattcaatttcaatatcactgcagaccctaataaaccacgtttttatattgacgaattcttaaaaaccgatatgttgtcggttaatcgttcacttcaaactactgtgttgaatgaacgtcaaaaagaagtgctggttaacgctggtgcagatggtaataagattatcgtaacgcagaaagttatacgtccttccatcatgcagcgtcttgtaggtgatttggctcctattcatctagatggtatttttcatccatttcgaattagtgacccatgctatcgttttgaacaagttgttgaatgcgcaattcaattaggtcaaccgctttatataaccgatccaaataatagctttgacagaaataagtatcctgaagaagcgctgattcgaatttttaaaccaactaaaactgagtactatcaaattcttaaaggacgtccgaagattcaatatttcgaaaatcctgaagaagtatttcatccaggtcttggtgagttcatctattttaatgctttaatttcttcaccgtataatatacctaaatatgaagatgtcgtaatcgaggaataaaatggctaaaattattttagtagatggcccggataatgctggtaaaacaactttcattaatgacataatggaaattagtgaaagatatgtaaagattgatttccctaaacgaacagttgatggacgtttcgatgttaagtctcgaaatgaagttggttgtttcgaaacgatgttgaattatttagaccctactaagatttatctgttagaccgtggatatattagtaactgggtttatggacgtattcgacaagatgcggactcggttcttgacgtttatgaacaggattatattcgtctttgccaaaaccatgatgtgttcacaattattttaacacgtaacgaaatgactgaaagttttgaagacgaccttattactttgtcttcattcggttttaatacagtcatttcacattttgaagagtttgcaattcataacaaaatccaaacgtatcaattacttaatcatgatggtgctaacaaagttataggatttaatgcaagcgaacgtaattatttgattacagaaattatcaaatgggctcgttaagagccatttaaagttttaaatgctgtataacccttagtatataatcatcttatcttttaaacatgagtaaaatataatgatgcctatggaaaaatacaatgtctgatttaaaatctcgtctgattaaagcttctacttctaaaatgactgcagacttgactaagtctaagctgtttaataatcgtgatgaagtccctactcgtattccgatgttgaatattgcactaggtggtgcactgaatgccgggttgcaatcaggcttaactatttttgctgctccttctaaacattttaaaacattgtttggactaactatggtcgcagcgtatatgaagaaatataaagatgcaatctgtttgttttatgactcagaattcggtgcttcagaatcttattttcgttcaatgggtgttgatttagaccgtgtagttcatactccgattcaatctgtcgaacaacttaaagttgatatgactaatcagcttgacgcgattgaacgcggtgataaagttattatctttatcgattcaatcggtaataccgcatctaagaaagaaaccgaagatgcattgaacgagaaagttgtaggtgatatgtctcgtgctaaggcacttaaatctctgttccgcattgtgaccccgtatctgactattaaagatattccgtgtgttgcaattaaccatacagcaatggaaatcggcggattgtatcctaaagagattatgggcggtggtacaggtattctttactcggctaacactgtattctttatctctaaacgtcaggttaaagaaggtacagaattgactgggtacgatttcacactgaaagcagaaaaatctcgtacagttaaagagaaatctactttcccaatcacagttaattttgatggtggtatcgacccattcagtggcttgttagaaatggcaactgaaattggatttgttgttaagcctaaagctggttggtatgctcgtgaattccttgacgaagaaacaggtgaaatgattcgtgaagagaaatcgtggcgtgctaaagctactgattgtgtagaattctggggtccgttgtttaaacacaaacctttccgagatgcaattgaaactaaatataaactaggtgctatctcttctattaaagaagttgatgacgctgttaacgaccttattaattgcaaagcaacaactaaagttccggttaaaacttctgatgctccgtctgcagcagatatagaaaacgaccttgacgaaatggaagatttcgatgaataatctcgatgatttaaatctagaaatcgttgatgaatccccttcttcggaaggggaggacattcgcaaagaacgagtgtttaatgaatctcttaaaattgtccgttcagcaatggaaaatgtcattcaagagattctgattacacttgaagacggttcccatcatatagtctatattacaaaactagactgggttgatggtaaaatcgtaatggactttgcagttcttgaccaggacagaaaagcagaacttgcaccacatgttgaaaaatgtgttacaatgcaagtacaacaagcttttaatgaacgaaccaagaaaaaatttaaattcttttaaggagttatcgtggtagaaattattttgtctcatctagtatatgaccaggcttatttttctaaggtctggccttatatggattctgagtattttgagcgtggaccggcaaaaaatgtctttaaaattataaagagccacgttaacgaatataatgcaatgccatctatcaatgcgttaaaggtggctttagataacagttctttaactgaagccgaatataaaggaacttcagacctaattgaaaaattggctgatactcctgaagaccacgaatggttggttaaagaaactgagaaatatgtccagcaaaaagcgatgtataatgctacatccaaaatcattgagattcagtctaatgctgaactacctccagaacaacgtaacaagaaaatgcctgacgtaggagctattcctgatattatgcgtcaagcactttcaatttcgttcgatagttatgttggacatgactggatggaagactacgaagcacgctggctttcttatctaaataaagcacgtaaggtcccgttcaaattaaacattttgaataaaatcaccaaaggcggtgcagaaacaggtacactgaatgttttaatggccggtgttaacgttggtaaatctttaggtctttgttcacttgctgcagattatcttcaaacaggtcataatgttctttatatttccatggaaatggctgaagaagtttgtgctaagcgtatagatgcaaacatgcttgacgtatcacttgatgatatcgatgatggtaacgtatcttatgctgaatataaagccaagatggaaaaatggcgttcaaaatccacattaggacgtttagtagttaaacagtatcctactggcggagctaatgctaatacattccgtgcattgcttaatgagttaaaacttaagaagaactttgtgccatctgtaatcatggttgattacttaggtatttgtgggtcgtgtcgtatcagagtttacactgaaaatagctacacattagttaaagctatcgcagaagaacttcgtgcattagcagtagaatctgaaacagttctatggactgcagctcaagtagggcgtgcagcatgggatgcttcagacatgaacatgagtgatatcgcagaatcagcaggtttaccagcaacggcagatttcatgttggctgtaattgaaaccgaagaacttgcacaagctgaacaacaacttatcaaacaaatcaaatcacgatatggtgataagaataagtggaataaattcctgatgggtgtacgtaaaggcaaccagaaatggattgagattgagcaagaaggcatgaacacacctaacacagtaaatgaaaacgcaggtgctcagatgcgtcaggcagaggtgaatcgcacggaacgcgtaggtaaagccaaagcaacacgtgctgacctagatagcttagccaacgagttaaaattttaataaaaaggagacttcggtctcctttcggggtttacatcttcctctaggcatgatatgatgtatttacaccaacaaagaggaaaacattatgaatatgtctcaagcaatttttactgcaatcaccgaaaacacaactgttgaagtagtttctccgctggcaacctacgttattcttgctcctaaaactattgtatctcgtatggaaaacacaggcaaacgtatcgtacaaatagttggagctggaaatcaaaaacttgattatctacgaaccatcaaagcttacgaacatttccaactcgaaaaaggttctcctatccaggtagaactcgtaaatggtgatatcgttcgagcaatgttccatcatttctatgcattgaatgacccatctaaagcggttcgtttaattgcatatgacgcaaaccaaaacgaaatcaacgcagatatatctaaattacatttttaagtttacttctccagtagttgtgttattatagacctatcaactactggagaacaaaatgaaaaccatcgattgtaaagcagaatttaagattttttatcacggttcaagtagttcagctaacatcgaaaacatgctttgtcctcctgaagaaacaggagttctgtctgaaactggacgtaagaaaaacttggatcgtgtattctttactgaagatatcggtttagcaaagatttatgcaggacgagcagcacgctcttatggaggtgaaccacgtctctatcgagtaatttctccggtagatgtagttcaaatgaatgatactaaaggtgctacagtttatcatgctgaatgggcattctgtgaggaaatatgagcaaattaactaaagttacttttatcggttggtttaaaagcggtgagatgttcactaaagatatcatgttatcaggtgatcgcgaagaaatcgagtgggttacggtacaacttgctgaagtgaacaatgcattagttaaagcatttattaatgacgagaaagtttttgaagctgatttcagaggataatatgtattcaactgtgtttaaaccgtcaacatacgaatttgcatcaactacacaatggaaagctcttattctggaaggatgggaactaatgatggactgcgaagcatctgaaaagtttccacacggcaaagtgggcttcgttaaatttgctgtacgtccgactaaacgacagattcgtcaagaaaaacgcaaatttcgaaaaagtttaaaatagctgtttacaagcaccacatactgtgttactatctttctatcaactacagaggaaattgaaatgaaaaaattaatcgctttagcaatggtatttggattaaccggatgtggtgcccatggctttatccctaataacgtcggccaattgatttacaatccgaatgttaaacagtacgaccaacctaaagttgaagtggaagacccggttactgtaggtaatcgaatgattcaagctgatgcccatgctcaacgttatcgtgactctgataccgtagcattgtcaaaagaacaacgcgttaaagaacattgtctacaggctactgaaatcgcattcattcgctatgttgaaacaactggtaaagagcctacccagaaacaaatcgcgaataactacgtccagtgtattgaacgtttaaacaaatttaattaattggtttacaccaaagttaaaataagatactataaacataacaaatcaagaggaaattaacatggaattattcgtagctagttcagtagcagttttaatcgcaggtattggttcaatcatcatttacatgttgccttgggtaatcgcacttattcgtggcacaaaaagcacaacagcaatcttctttgtatctttactctttaactggacgatggttggttggattggaactttaatttggtctatcgttgccgaaaagaaatcagctcagcagcctcaacaagtaattattattcgcgaaaaagaataaacttgtttacattatagatggactatagtatagtagtcctatcaaatcaactaaggagttaaaatgaaaaagttatcattggcagcaatcttacttgcagtatcatgtgcaccggctccagttacggcaggttatgataaagacctctgtgagtggtcaatgactgcaaatcaagaagatgttgaacaacaaatcttctctgatatcatgaacatcactaaacgagaccgtcctaatatggttaataaagttgttgaacaacttaagtctggcggtatcatgcagtacaactatgttttgtattgtgaccctaatttcgataacaaagatatcgtaaccgaaatcacaggtgaataatatgatttattatatgcacaaaaatgcgccatttaaatatggtaaatttcctaatgcacaatgttataatataacgccgaatgaaaataataacggataccatattggtgtaatttttgtaattgttaaagataacgaaatcgttgcctgggcagattttaaaggtacaacatatgatgttaatcctgtgcctttcacatattacaatataatggatttggcatatgattataattggtttaataatgacacgttggctcatattgaaggtgtaggatttgacatctcttattctagctattcattatgtcctatgagccgagctcacggtaaagatgtatcatatctttcaattcggaaacgtgtaaacttcaaacgtagtacagagtatgttggtggactctttgttaaagataataaaataacccgtattagttatcctttaagtgtaggtcaaaaagatgttgatgttgatttagacttaactgaaaataacattaatcgtattgcttctgtatattttgatatcgatgaaaaaattgtagtgtgtggatacgaattaccacctgaagaaaaggctgaagcaattgaagtcgaattagaaatttctgttgatgaccaaatatttaatgcatttatgaatcgaggttaaaatgactactgcaatttgcactggttctaaaattagtgtttttacaagttttgaggattatgaagttgtttcaaaacaccaatgccatattagcgtaaaagctaatgacggtgtaatttggaatattccacattatgaagacactacatatgaagtcacagatgcgaacggtgataaagcgatctttgtgattgattaaatatactcaggaggtacctatgggtattattaacactgcaatagattctgtttacgcatataagtttattcgactaatgcaaaaaccttttaccgaatggaaagcatacgaagccaaaatcatcgatgaacgtggaagtgttcttaaacgcccttccactcctgaagagaaagcggcttatacaccttttcatgcttcagttcgttcaatgaagcgaatgatgaacactgttccaggtcttaatggaatggcctcaatgatgtctgcttggagtgctgtagcttcacgctataacattacggaagaacaacagaaagaaatatttaaaaaactccctttatttgaggatatggttgctggtgattcagacggcaatcctcaagctattgcatcaggaacaactacaggtgcagtcgtaaataaaggtcccgaacaaattccttccaagaaaagaaagcgaattaaagtaaatattaataagttgtgataagatggccttattaatttaaggcctctggagaatactatggctgaatggatagataatgaatttgcttatcgtgcgttttctcacctccctcgttttagacaaatcaataattcaagcacatttaaattaacgtttcgttgtccagtttgtggcgactctcagacagatgcaatgaaagctcgcggttggtattatggcggtactcctggtaatgtacattgctataactgtcaataccacaatacaatttccggatacttaaaagagtatgatgaagagctttatcgcgaatatctaatggaagttcgtaaagaaaaagctagaatggaaccaaagattgaaaaggttcctgaacataaaccagaaccggagaaaaagactataaattctttgccgtcttgttctcgtctggacaaactgcctgaagagcatcctattgtgaaatatgttaagtctcggtgtattcctaaagaatcatggaacagattatggttcacattagaatggcccaaattagtcaacaagattcaacctggtacgtataagaaagagattcccgaaccacgtttagttattcctatttttaataaagatgggaaggccgagtcattccaaggacgtgcacttcgtaaagatgctcctcagaaatatatcactattaaagcgtttgagtctgcaacaaaaatttatggtgttgaacgtgttaaggaaggagacgtctgggtaatggaaggccctattgatagtttattcatacccaatgcaatcgctattacaggcggctcgatagatttagatgtggtaccatttaaagaacgtcgggtatgggtaatggataatgaacctaggcatccagatactatagctcgcatgaagcgattagttgatgcaggcgaacgtgtcatgttctgggaccgagctccatggagatcaaaggatgtgaatgatatggtaatgaaagaaaatgcaacaccacaagaaattttagaatatatgaaacagaatatttcaagcgggttgcatgctaaaatgagattatctcgttattcgaaaatttaaacaagccctataatagcaaaggccaaatcaactacagtatccaatggaacagaaggaaccataacaccatgggcaactaacaatggtgcaatcccgaagttccatgaaataatgccacctacaactattgcagcgatagcagttttctttttattgcctttaatagcgttgattaacgatggaagtttaaacataatatctccttagttacctattatttattacgctttataaaattaatgttagaattaactctcttatactgaattgaaaggaaaaataatggcacactttaacgaatgttcacaacttatttctggtgttgataaagcagaagaagcttattttaatgctctgattcacgaagataaagacccactgcaggtaatgcttgatatgcagaaatctttacaggttcgtctggcaaatgacaagcctgaacataacaaacatcctgatgaattggccactgccggcgatgttgttgattggctgcgtaatcagaaagattatattgatgatgaattccgtgaactgctgacttcacttggtggtatgagcaatggtgaaaaagccgctagctctgtgtggaagccatggaaagcacaacatgctgaatatcgtaatcgtcgtattgatgaactgtctcctgaagaccagctcgaaattaaattcgaaatgattgatattctgcactttgttctgaatatgttccaaggtctgggtctttctgcagaagaaatctttaaactgtattacttgaaaaaccaacacaactttgaacgccaggataatggttactgattaagttataaatacacctgtaattaaacaacaaaggagttaattatgggtggttatgtaaacatcaaaacctttacgcatcctgctggtgaaggtaaagaagttaaaggtatggaagtttctgtaccgtttgagatttattcaaacgaacatcggattgcagattctcattaccaaatctttccatcagaaaaggcagcttattctgatgtcgtttctgatgcagctgactggaaaactaagaatgctgcaatgtttacccctacaccagtaagtggttaaataatttaaggaatccttcgggattcctttttttgtttctacagtttacaaccactaaaaactgtgttaagatattcttacttactcaagaggagaacaatatgttaaatcgttggattaaacctaataacacattaggtgctttgattgctcaagaagtttcgttgaaatacggtcttggatattacgatgatgtagtcgtacactcattcatgatggatggtgaagacgtcaaatttaatgccgaaatccgctgggatgacggtggtgttcgttttgttcgaggaacaattaatgcttacgatactgaagaagttgtttgctgttaaaccaggcgaaggtatgatgcctattcctgatacacacgaaaaaagttgggaatatatcggtgatggaatgatggaagaagttgttcgtccaaaaacaaaacaggttaatgcttcaagctcttcaagttataatcattcatacgtatcgtcttggcctggtgattctgggtcaagttattctgattgtggttcaagctcagggagctgcgaatgaacaagatagttaaatggtttaaaagctgggacgatggtgtaggtccagaagattggctggatgttcttgaagagaatatggctaaagaattccagaaacatgaagaaaagctcgtcgaagatgaaggcgaacgtattgtaaaactttatatgggtgaaccatcgaggaaattataatggatgctatgttatttaaaatgtatttgcttgaagccaagtcgtttaaacatataccagtagaagataagactccactagaaatagctattctcattaacaaaagtctaaataatccgcaatatatcgtagaagaattctgcaaattgcagattcctaaaggttacaaaattcgtgtagagcgagttggagctattactcattctaaaaattctccgtttagtcttgaagaaggcataaaggacttagggtatgaatctacagaaaatgctgtttatgtgaatcctgaaaagcgtttagacctgtttgaaaagcgagaccatacgtattttgccaaaaaatactttattacatcattagcagatttaatccatttgcaacgagctatttggaaattttttaagacaaaaggtgtagcactagaaacattctctgaacctgctagtttttatttaggtgaataatatggaccttatgagtatgtttgacgagcctgaagttgaggctcctaaagtgcatcgtagtgaacttgttgatgaactagatagtattatacagcgtcatggctttagtttaccattagatgtcctgaaagacctcgcctcttattatgatgaccctccaccatggagtccttggaaatgaaagagaaattgaaagagaaattcttactagaaatcaaggaaaaagactttgagacatggtatcgaatggtgaaagggttgacattgctttttaaagcatcgttattcatgttagaacaacctggccctgatggacctttagtaggaaagcttaaaaagtagtttacattccctcctctcgtgttatgataggcttatctttaaatggaggcctatcatgacatgtcaatctgaacttcaagaacgtgaatacctaacaaatctgattgatagcaaattcacccgccaagaacaaaacattctctgggcttgcaccgattctaaggaagacccggatttccactatgaattagaccatcttgttcgtaagcatatgacttctacagtaccagtagaactctaccgtggtgtaactccagaagaagtagaacgtctttcacttctttctgttggatgccattggtctcctggacgagtaacatcgttcacaactgatttcagtacagctcgtcaattctctgggagatgggaatatcagacgtacactattcttagtctcaggaatgctccattcatttttgattactaccaaaacatgattaacattgtactcgccggaaagaaccctaagcatgttatggaagaaacgcgtgttgacgtcctagatatgattgaatctgaacaagagtacatggtctcaggtatctctagatttgagattgtggaaattgaagacttagaatatgaccctttatctcgattatacaaaatcattcatttgaaaatgttgaatttttagtgtacaaactcttccgatgatgatactatacctttatcaaccacaggagaaacctaaatgtttatgccgtataacgagtgtgaaattgaagaaatggttcgtcgtgctcaaaaccctgaatatcaagatgtattgcagtacgaaattgatagtcaattcagcgacattgaacaaagcgtcctttggcagtgtatggaaaacaagccagactgtattcaacaggagttaagttcaatcgttcgtagaaattggacgtcttctgttcctgagacaatgtatcgtggaatctctaagaaaactatggccacactcgatgataaaggcattggtagtattattaaatttgacagagtaatgagcttcagcccagtgttcggtgtagcacgtaactttgcttcgtataatttttacggaacatttaatatgttctgcatcaaagatgcaccatttgctttcaacttccgtgaacatatgcttagcatgattctggctgcgccatcttgtgagttcaatggagctttccctgaagcgacaagacggtctaatgctagacttatatccgacgaatgtgaatttatgctccctatagggactacactgcgtgtagattctattattcaggatggacgttatacaatctggaatctgtctattgtcagttactgactgaattggaataaccgaatggaactcagaaccattataacacataaaaaattaaagcattttacgaaaaaagagtgtacactacctgagggcatgatattataagcttatcagctaaatgacctaacgtccgtaagacagaggaaaatattatgttatcaaataataaaattaacaaaatcaatcgtcgtcttgaccgcaccagagcttctgcgaagagacgctctaaggattttaacttagactttaattaccttaaaaacattcttgatcaaaaggtctgcgcttactcaggtgaatctttcaataactctgttgaaggtgagaaattatccttagaacgttttaataacgatatcggctacattaaaggtaatgttatcccggttaagaaaaaatataacacggctcgttctgatttaacactagaagaacttattgagaaacgtgacgctgttgcaagacgtattgctaatccttctgcccgtaaagtagagaaacttaatctcgacgagaagaaatgggcccaaattaaaaaggtttatgatactattttaaaaatccgagcaaaacgtgaaaatcgtgttaagcatatggcgaacatgatgaaaaatcaacctttatctaacgaatctaaacttagaattgttgctttgaaagcacgcattaatggctcacaccaagcagaaggccatgaacttactaaactcaacgttcttcttaaaggctctgactggaaaactaaaactaaattaactgatgctgaatcgcttttcgatacatatgataaagttatccaaggtctgcaacgttttgaaaagattggtttcattggtaaattaaaattgaaacgtggcttaccacttagcgcatcattattccaactgattaaaggttaattatggtttatgtatatgcaatagtttatcgagatatggaaggatttactgtcccggttccacttgatgagcatcgtcctgcagtattttttagaaaggatattgcagataaagttttcgatactttgaaaacacagtataaaacagatttaaaaatgggagttctaagaatggtcgaaactccgcgtaagttctggtttaataagcttgaaatgaaacacgttaaactagatgcggagacgcaaagattgtatcaacgaatcctggacacaggccgtattgttagtattccaattgcagggactttacgatgacatttgatgatttgactgaaggccagaaaaacgccttcaacgttgttatggaagctattaaagaaaagaaacatcatgtaactattaatggaccggctggtacaggtaaaacaacccttactagatttattgttgaagctcttatttcttcaggagaatcaggtattattttagcagcccctacacatgctgctaaaaaggttctaagcaaacttgcgggtcaagaagcatcgactattcatagcattcttaaaatcaacccaactacatacgaagaaaacgtattgtttgaacagaaaaaggttcccgacttagccttgtgtcgtgtactgttatttgatgaagcgtcaatgtgcgaccgttctctgtttaaaataatgttagctagtatccctaaatggtgtacagtaattggaatcggcgaccgatgccagattcgtccggtagacccaggcgaatcaactgcgtatctaagtcctttcttcactcacaaagacttcgtgcaatgcaaccttacagaagttaaacgtagcaatgcaccaattattgatgttgcgactgatattcgtaatggcaaatggatttatgataaagtagttgatgggcacggtgttcatggatatacagaccttaaatcgtatatgatgaactattttaacgtcgttaaaactcctgaagaccttttcgaaaatcgaatgatggcattcacaaataagtcggtggataagttaaattcaattattcgccgaaaacttcttgaaacagaaaaaccatttattaaagacgaagtcattgttctacaagagccgtttactaagacgtacaagctagatggtaaaaatatgaccgaaatgcttttcaataacgggcaattcgttcgtattcgagatgctgtagaaacgtctacattcgttaaagcacgtggtgtttcaggcgaatatatgatacgatactggaatcttacagtagaaacatatggtgatgatgaagaatacatccgcgaggatataaaggttatttcttctgaagaagagctttataaattcaatttgtttttggctaagaccgcagaaacatacaaattctggaataaaggtggtaaagccccatggagcgaattctgggatgctaaacgcatgttcactaaggtgaaggcactacctgtatcaaccttccataaggcccagggtatatctgttgacacggcctttgtttatacaccgtgtatccattatgccgattcagaattagctaaacaattattgtatgtcggcacaactcgtggtcgttttgacgtccattttatttgagagaaaattatgagcactgatgttattatagattttgaaacattcggcaatacatcaaaagcggctgttattgaccttgcggttattgcatataattccgaccctgaagttgttgaatcatttgaagaacttgttcaacgaggtaagcgaattaaatttaatttagcttctcaaaaagggaagcgagttttcgctaaatccactatgaaatggtggaaagaacaatcggctgaagcgcgtaaaaacctggctccgtctgaagacgatgtcactacgcttgaaggcattaaaatctttttagactattgccgagataataaagttgaccaatggaaatcgcagatgtggtgccgtggtatgagctttgacttcccgatcttggtcgatttgattcgtgacctctatcgtgatgaaggtgttcttgaagcagatattgatactgataaattagaaccggttaaattctgggctcaacgtgatattcgtacggcaatcgaagcttactcgttgacacgaggattaagtatgtgtccattaccgatgggtacgctaaaaggattcgttgcccatgatagtattcatgattgtgctaaagatattttgatgttaaaatatgctcagcgttatgcgcttggccttgaagatgtccctgagaatcctgacccgttaagtgtaaaacagcgataaaaccggtttacaaccaaggatggttggagtataatctttctatcttaaccaaacaggaaaaacattatgaatatcaatactacggctacttacatcctgaaagacgaaaaacaaatcaactggtacggtgcttcagtgcgagcttatgaaaagttttgtgaaattttaggtgccactcaaggtaatagtttcactattgttaacttcatcaaacaagctgaaggcccttggttattcttagaaattaaaaattcacacggtacaatttctactaccgcccttccaagcactgactttgaattgttgattgaagaagtagaacccgttaaagacatctgtattgatatggatatcgcttgtatgtacggtactctgattaagcctattgagcctactgatttgttgtgtaaagctgtttcaattcgacgtccgttcgcaggtccagtgagtggatgggtaactgatcagtggattgaagacggtgttgaacttctgaacgttgttcacgcaggtgattttagtgtagttccacgtagtgcagtagttaatattcttaattaatattttacatccaaggatggatggagtataatgaattcaacttaaacaaagagagaaactatgattactattggtgaaattaaacgtgtatcgacagcgtctcgttctaaagctgcaggaaagctggttgaagtggtaggacttcgtactaatggcatgggccgtattaaagaagttaaagttcgaatcattcctagttctggaaaaactgaaactcagttcgcctatgtaagtcctaaattcttggaaactcgtgtaagtgcccactttgcttcaagcgatatcgttgagcctactacacagttcaaatgggccttgtgtaaaggtgttgaattccagactgataaagaatttgacttcatcgatgaatacggttatccaagcaaaactgatactatgtgtggcttcattagcgaccaatgggttgaagatggtgaaaagttatacaatatcgtattcttaggtgacttccgagttgttaaagaatctgaaatcactcgctatgtgtctcctcgtaaagcttaaggaattattatgaatattgtaaatctctctacaggcgattacgtatatgtatctgttgcttctcgctctaaagttgccgggaagttggttgaagttctttctgtgagtgatccggtttttggacgtaacgaagttaaagttcgtgacgctgatggtaacattggttacgttaaaagccaattcattgaaccagaagaaaaagcgttcaaatggaaactgtgcagatcggttttagttgtaaaagaccatgagttcaccattgctgcggcaacagatggaacaccgtggacaacgaatcaagttgctggttttatttcggaccaatgggtagaagatggtgttaagctttataacatcgttttcgctggtcagttcatggtagttcctgagttccaaatcaaaaaatattgtccagcatcttttgcataaagttgtttacttctcctccggttttgatattataaccatatcaaccagaggagaataatatgatagtttaccgcgtagaacgtagtttttgtactcaacgtgaatcattaccaggaattgctatcgaagacggtaaagccgtcagaatttgggaaacctcttggaataaagaacctcgctcaccatacggttggtcaggcaccgacaactctgaagaaacatgggagttccttgataagcatggaatactctcgggtaacttctaccatcatggcgacaactataatgtccctaatcgtcctacagtaaatgaagacaaactccttgaacaaaatatcttaagatactatagaattgagcacacatttgaattgagtgaagattgggctcaagggttctattttggatttgaaagtgttgacgcggtttatgcatggtttgatgcccaggtggatgttgaactcttgaaagctaaaggatactacatcgccgtctatgaagcacctgatttcatcctcggaagttgtcaattaatgtttagacgttcattggcagaacaagttgattttattttgctaaaatgatgtacaacaactatggtctatgatactatagacctatcaaaacaagaggagaatattatgaaacgtcaaatcattaaaaacgtaactactgattcaaacatcgatgagtttgaagatgttctgtttaatcctgatttagttgttgtacagaaaaactggaccgaatttttatgctacactgaagtggtttacgtttacgaaaaactcggcgatgaaatgcctatctatggtatcttccgtgaaatcactgaaaacggtacaacttattggaaggaaacttactaatggctaataaattccgcgttaactcatggtaccaatttaaagataaacgtgcccaagaagagtttattaaagaccacactgataatgggatttatgcacgacgtcttggcatggaaccatttaaagtattagatgttgaccatcttggacgtcctactaaaattgtgacatctactggcatggttggatacgcaacaggcggtgatatccttgatgaaaactttatctggctctccacgaatgaagcagagttctttgacgaagttggaaatccatatcaagagtctgaagagcaagattctggcgaacttgacgaattgtctgaatttcctgcgatgacgattactatcaaaaataacgaccaggcatggtctttgtatcaaatgttgaaagctcactttaaggaacaataatgccgttatacgactataaatgtcaatctgaagattgtggtcatgaatatgaaaaaattaaaaggatttctgaacgagaaaacgatgtttgccctgaatgtcatcgtctgtctactcgtcgggtttctgctcctaaacatgtgaacggtggtttttacgacttacttaagaagggttaattatggcttttaatacgtcttttaaaggttttaaaggttttgaagttggtaagaaatatcgtattatcaaaggacaggaagataatttcttgagaattcttaatacgactggtaaacgtcttaatactaatctgcatactactttattgtctaaagattttattgtggaagagatgattggttatggtgtttcagtgattgctgtagaagccgtaggcgattatggccgaactattcatagtatgcaaggtgatattctgatttatggtgcagaatttaaattctttgaagaagttccggaaccagatacagctgtcgatttcaaaaaaggctctatagaatttgttgatggttcggtgatcgtatcaggcgatgtggtcattacggttaaaagtgaacaagggcgtttagctgcaattgatacacttcagaaaattaaatttaaataagggcttcggccctttttgctttagatttcggatgatagaataccttcataacgaggagacaacatgattaaaaatgaaattaaggtattgtcagatgtagaacatattaagaaacgtagtggtatgtatattggttcttcggctaaagaagcccacgagcgttttttgtttggtaaatatcaacaagttgaatatgttcctggtctggttaaattaatcgatgagattattgacaactcggttgatgaagctattcgtacatcatttaagtttgcaaataaaattgatgtgcaaattaaaaataatcaagtttcggtggaagataacggacgtggtattcctcaaggtttagttaccgaccaaacaggtgaacaaattcctggacctgtagcagcctggactattccaaaggccggtggtaactttggtgatgactctgaacgcaagactggtggtatgaacggcgtcgggagtagtttaactaatatcttctctacgttgtttacaggcatcacgtcagatggcgaaaacgaaatcactgttaactgttcaaacggaatggaaaacaaatcatggtcttctaagaaatctaaaggtaaaggcactaaagtaatcttcactcctgatttctcttcatttgaagagcataatttatctcaaatttatttagatattactttagaccgacttcaaacattggcagtcgtttatcctgatatcaagttcacatttaatggtaaaaaggttgatggtaattttaaacgatttgctaaacaatttggtgaagataacatcattcaagaaaatgataaagtctctatagcattcacaacatcaccagatggcttccgtcatttaacttatgtgaataatatccatactaaaaatggtggccatcatgttgaatgtgtaatggatgatatctgcgaacatcttttgcctggtattaaaaagaaatataagggtattgaagtcactaaagctcgtgttaaagaatgtctcacaatgttgatgtttattagagacatgagcaacatgcgttttgattctcagactaaagaacgtttaacgtcaacgtatggtgatattcgtaatcatatccaattagatgctaagaaaattgctcaggcacttcttaaaaacgaagccttgattatgcctattgttgaagcagcattagctcgtaaattggcagcagaaaaggctgcagaaactaaagcagctaaaaaggcaactaaagctaaggttcataagcatattaaagctaaccaatgtggtaaagatgcagatacgacattgtttttaacagaaggtgattcggcaattggttatctcattgatgttcgtgaccgtgaactacacggcggattcccattacgtggtaaggtgatgaatagctggggtatgtcatatgctgatatgatgaagaacaaagagctctttgatatctgtgctatcacgggtcttattcttggtgaaaaggcagagaatacgaactatcgtaatattgcaattatgaccgatgccgatcacgacggtcttggaagtatttatcctgctttgcttgctttctttagtaattggcctgaattgtttgaacaaggacgtattcgctttgttaaaacacctgtaattattgcacaaattggcaaaactcaaaaatggttttatactgtagctgagtatgaagaagttaaagatacactgcctaagcatagtattagatacatcaagggattaggctcccttgaaaagtcagagtatcgtgaaatgattcagaaccctgtgtacgacgtagttaaacttcctgaaaattggaaagaactctttgaaatgttgatgggtgatgattcagaacttcgtaaagaatggatgtcctaagctccttcgggagcttcattttaattttaataaggcttaattatgaaagttatgtttatcccatctcgtgcagtcccatttaacccagaacgtgtacaaggtggtcttgaagcagtacatttaaatgtgttgaaatatcttgtgtccatcggtgccgatattgattatattggttttgataatgacacatttggtgattggaaggttaatcatcatcctgttggtcatctgtcaaaattcagtctaggtatgagttatactatggctcgtaagattgttgaactagccggcatccatgaatacgattttgttgttactatggaaccgactaaactaaccgttcaggcaattaaagacgcaggtctctctaaagttcataagaattttatggcaacaccatttgaaccggtatctcgtggcattgttcaaatttgggaccagactattcaaattcataagaatggtggtaagagttatgctcctactaaagccttccgtgaatttgaacgtaaatattgttatatgacttcaggtctgactgacaaaattgattatgattattggcgagcaaatccgttgtttgaagccgaagattatccggttatttgtttgactgaaaagccagaagttcttccggcgacggatctgattattagtgcacaacgttatgacactaaaatgcgtcgtactgatgttgctcttgaagcgattaaagcactaggcgaaaatggtgcaggatactgtccaagcaaatgggcgccaccggctaaatatcctgttattattgatgctccacacagtgaaatcatggaacgtcttaaaacagctaaagcacttattaatacttgtcctgacacaggtacggtagagaatagttctattgaagccatctctaaaggtgtccctgtaatccagttagtttttaaggattatcctcatgcgacatttgaatacgacccagatactgtgcgtgtagaaattgattcatctactcctaagaaagaagtagttgcgctttacacaaaagctgtattagaattcactgacacatacgaagctcgagttaaacgtgctgaagcagtatggaagaagtataaccgagatgcagttgttgcgatgtgggataaaatcttcacagcgtaaatcctgaatagcctgaggcactattacacataagatgatagattatatggtctttagtaatagtgccctaggaatctactgaagagaatattatgagaacatataacgtggacttggaactttttgataaagcagtgctccgggaattccggcttatccaaagattttttgatatcgagtcagcagagtcctttaaagaacgctttaaagaaattcgatataaaatacaaaccgatacagctactaaagaagaacttctcgaagtggcagaaatttttaaacgtaacttgtgatgagagaaaaatatgattattgaaacggctaaagaaacgattattggttctggtggtaaaagcacagcatttactattcaaggcaatagcaaagtttataagattttgtctaatgacctttatacaaacaaagaattggcttgtgtacgtgaattaatcacaaactgtattgatgggcaaattcttaatggttgcactgataagtttattgttcaggcaccaggtcgtttagacccacgttttgtagttcgagactttggtcctggtatgagtgatttcaccattcgaggtaatgacgaagagccaggaatctataactcatattttgcttcaactaaaacatcgagtaacgatttcattggtggattcggactcggctctaaagctccactagcatatactgatacgtttaaccttacgtcttatcacaacggtgaagttcgtggttacgtaatctaccaagatgacacgggtccacagattaagccaaccttcgtagataagatgggacctgatgaccggaccggcgttgaagtagttgtgcctgttaacccagaagattttgaaaagttcgcatccgaaattgcatatgttatgcgtcctctaggtgatattgcagaagttcgtggtgttaaagatattaaatacttccctgaatttgacgatgtatatttggccaaggaagctccatggggtgaacgcggtaatatcatggctgtttacggtggtattgtatatccaatcggaagtgttattaaagaacaaacatggatgatgacacgatgcactacagcttatattaaattccctatgggtgaactagatgtagccccgtctcgtgaagcattgtcatttgataaacgtacagtagcaaatatccataaacgcgttgcagaaatcgatgctaaattgttcgctgaagattctaagaaatggattgattgtaaatacccgcgtcatgtgttccgtgaaattgattctcttggctataccgctcgtaaatacatggaaaaggccgggtctaatattgaatcactgaaatactctaaagaacaactaacttattctgagttgtacaaacgttttaaaatggggcctgagtggtgtaatcttggtgtcgtatacgatatcgttgaatcccctcgtcttcgtcgtattcgtgaaagtggtagctcatcgacaactatttcaattaacagtctgattggcattaacattaaaaacgttgaaattgttattgacgacgttaagggacgcgttccattaatgcgagctcttaattcaattgaaatgtctaaagacgaggttaaattaaccggtaaagttccacgcggttttggtaaaagcgtactattcgttgaccctacagacgaagatgcaatgaaacttctggaacgccttaaagttatctttgatggcgacaacattaacatgtacaagacttcagagcttttacaaatcgttaagccatggattgaagtcaagactcgttctaatgggcctcgtcctaaatccccaagtgctcatcggttctttaagaatgaaaacgatgtttgggtatcggaagatctctttattccagcgagtgaagctgatgaaatccaaggttatgctatagttcgtaatcgttctaatgctgaatgtcttgacgcagataaaggttggttgaactacgactctaatttcttgacccgtattgccgatttgtcaggtattaaagagttcactgtagtccgtccacagattgctaagaaagttcgtaaacttggtgaagtagaatgcttgtttgaaaaatcaattaatgactatattatgctaatcgataaagtagattatgatgagtatgtatcaccaagtcgtagagcacagccttatttgaatcatattactcgtaatgaagagcttaacttccttagtaagtattttagctctaagaacaaagaaatcagtaaagactttgcaaaactctcaacagtaaataatcgttggggatggaatcgattcgcaggtgctactaatacagacctgaataagaagttagaattgtgtgctaaaattttcgataagcttaaagataatgcttatgataatgatgataaaatggttattgaattcgaaaccaattatcatattgtgtcagaatacatgggacgacgtggtactctttcaaaagaacaggtcgctcaaatcgttaaattcatgaaggccgtggaagcggccaaataaggaaacattatgtacaatatcaaatgcttgtcccaagaagaacagttagaagcttacggcctggttgaatcaggcaaatggactcgtaaagaaattgccgattacttcgacatttcaacagatactcttcgtaagattgttaagaattttaaagcagaaggcgttgtccctgaagcaaacgatgcctcttatgtaatcgaagaagttccagaaaatgatgaacctattatcggcggccatcgtcctgaaatcgtatggaacgcgtcatctaaatttatttcaattattgaaggacgcgtagcatacaatgcgactccatcaagccatgcaaattttgaagaaattaaagctaatctggtcgcaggaaaccttagtaaagctgtcgaacttattaacatcaagaaagctattactaagtttgttgatggtaatgttactattgaaggtggtagtttattttatcaaggtatagagattcgttcagggctggttaaccgtattattgattccatggaaaaaggtgaagactttaaattctatctgccattccttgaaaacctgttagaaaacccaagcgaaaaagctgtacaacgtttattcgacttcttggttgcaaacgatattgaaatcactgaagatggacatttctatgcgtggaaagtagttcgtaaggactatttagactgctatagtggtacatttgataactccccaggtaaagttgtttcaatgcctcgtactcgagttaacgacgatgatactcaaacctgttctcgcggtctccatgtttgtgctaaatcttatattcgccactttggttcaagctcagataaagttgtgaaagttaaagttcatccacgtgatgttgtatccatcccggttgactatggtgatgctaagatgcgtacatgtcgttatgaagtaatttcagacgttactgaattgtttgcagaataataattggggacttcggtccccttttttctttaggggtaattatgattcatccatttgacgtatcagaatccaaaattgctaatcttcgtggtcatcataagtgtaaatcagtttattgtgctaaattggtaaaacatcctggcgatgcacactacggctggttagaatgcgacgaagttgttattgaaattccgacggtagatgcagaatatcttgaagaaggtgaccgcatttattttggcgaactacacatcagaggtatctatggtaaagacgaacttggggctgttgaggctgaagagtcttccgacatttatcctgtcgaatgagtttttgactagcgaaatgaaagttaagatcgctgatactgctcggtactcgttgaaacaagatccaggtcaaataaaagaagacgttgttcgacgttgtaaggttgcagtctttgcagagtatgtagtagcaaattggctagacggatatgttaataaaggtaatgaagacgtagaagacccgtacacgtatgcatgggacgttttagctcatcctaagtactgtggtctacgcgtagaagtaaagacccatcagatggattcgaaatggatttcggttaccacaggatacagtggtgattatccgggtggtaatggaatcaatatagggcccttcttgaaccatcgagtcgcagattgcattattatattagatgccaaagaaacctcacctgacgtcttctcttattctataaagttcgtgggagaccatgaagacctaaagaaaatcgtccgcaagagcaactacaacgggtggtatcttcatctttaatttcacaaaagtgtttacaactaagtaggactatgatatagtagtcctatctaaaagaggataacatcatgaaatttaaatttttctacgcaaaacataaagtaacaggcgaatttgtttcaatgtacaacactgcagatgacgaagggatgatttatacccatttgggactatctcattgggactcggacgtgccttatatgtcatctgaagccgaaataactcgtttagttaacggacatatgaacgaccattttggtgttattctttctaaagaccttaaagaggttatcaacaaaggatatatggaactcgcggaagttgagatatgagctctaaaatgtggataggaatatggttgcttagtatcccaatgatttgtataatattttcaattgtgttgaggtacttatgaaaaatgcacttcttattgtactaagaacaatttgtgatactggtttttacattgcatgttcgttcactggaacatggttggctttaacatattttaatgtaatttaattgtttacaacaaggtaggattatggtatagtagtcctactgaaacatgaggaacacaaaatggctaagctttttaaagatgttgaaattggtgaaaaatttgttctgaataacggtcagcagcttattcgtgtagcttctatcgccggacaaactcataactgtatcgccccaacgtgttggactcgattctttattgaagatgacactgaatgtttaactgttgaagagctttttgaacgttctgatatggccgaataaaattgtacaaactcttgagagcagagtataatgctctcatggattacaaaaacattaatcaattgaggaaattagcatgtccaaatatttaactcgtaaagaccttctggcagttggcggtgaagttgttgcagtagttcgtaatggcgaatacggttctgaagtttctaaagagtttcgttctcgtgaaggtttttacttcttcgttaaaggttcatctgattggcgacaagtagcagcacgattctttgtaggacgtcaacgttctaaacaagggttggatgcaattctttctcacattcgtcaaggccgttcacaactagcccgtaccatgggcactaacaatattgaatatgatgtaatctttattgcagctaagaacatgaaaccactgaccactggttatggtaaaggtcaattggctctggcattcactcgcaaccatacatcagaatatcaaacactcactgaaatgaaccgtcttctggcagataatttcaaattcattctgcagagttactaatttatacgggcctattaagttgggcctttaatttatttttgaggtaattaaaatggtagcatggattattgcattgctgtgttggtcgtttttattcgttaacactttagttacaggcgaaacaacagtatttcaacaggccgtatcacaaggtaccttagcggtcttagctcttcttaacgtgttaaaaggcgagtaatgattaagaaattcttagcaggagccttcgggctcttgttgttgcttacggttctgtactacggtgtgatgtttggactaatccaagtagtgcttttcatttcagatgttataatggttattcgttcattaatatggtgaaaatatgcaattgaattctcgtaatctaaaaagtattattgataacgaagccttagcatatgcgatgtacaccgttgaaaaccgtgcaatcccaaacatgattgatggatttaagccggttcaacgttttgtggtccatcgtgcgttagatttggctcgtggtaataaagaaaaatttcataaacttgcgtcaattgcaggcggtgttgcagatttaggttatcaccatggtgaatcttctgcacaagatgcaggtgcattgatggctaacacatggaacaacaactatccactgttagatggccaaggcaactttggttctcgaacagtccaaaaagctgcagcatctcgttatatttttgctcgtgtaagtaaaaatttctataacgtatataaagatactgaatatgctccagctcatgaagataaagaacacattccaccaaaattctatcttcctattattccgacagttcttttgaatggtgtctctggtattgcaaccggttacgcaacaaatattctgcctcatagttttaaatcagtcaaaaaggctgtattacaagctcttcaaggtaaaaatgtcactaagccaaaagttgaattcccggaattccgtggtgaagtacatgaagttgatgggcgttatgagattcacggaacatataagttcacatctcgcactcaaatgcagataactgaaatcccatataaattcgaccgtgaaacgtatgtgagtaaggttctcgacccgttggaagacaaaggtctaatctcatgggaagatgattgtggtgaacacggctttgggtttaaggtgaagttccgtaaagagtactcgcttcctgatgatgaagagctacgtcatgaaaaaatcatgaaagattttagtctcatcgaacgtcgttcacaaaacatcacagtaattaatgaaaagggtaaattagctgtctatgataacgtggtggacttaatcaaagattttgttgaagtccgtaagacttacgttcagaaacgtattgacaacaaaatccttgaatctgaaaaagcatttaaactggcttttgctaaggctcacttcatcaaaaaagttatcaacggtgaaattgtgattcagggcaagactcgtaaagctttgactgaagagctagcacaaatcgaaatgtataaagaacatgtcgataaactggtaggtcttaacatcttccatatcacttccgacgaagcacgtaaactagcagaagaagctaaagctaagaaagaagaaaatgagtattggaagtctactgatgttgtgacagagtacactaaagacttggaggcactttgagtgccctagccttaggatttctcggtgcaatagctgcactagtgatttggctgtattggttggacaaacatgattaaggagcttcggctcctttttgtgcattttttctcacaaaacagtttacatgtgcttcaaacatgatattatagacctatcaaaacaaatactaatttggagaaataaaatgtctaaagttacttacatcataaaagcttctgaaaacgctctgaatgaaaaaactgctgcaataatggtttatatcattaagaacaacttcaccactgctgccaatgtccgtgaagctctggaagcagaatacaatgcatcagttgttaactctaacattggtgtattgattaagaaaggtttagtcgaaaaatccggtgatggacttgtagcaacaggcgaagcaatggatattatccaaaaagctgcagacctatttgctcaagaaaatgctccagaacttcttcaaaaacgtaacaccagaaaagcacgtggagttactcctgaaatgcatgaactagcaaactttgtttttgaaaatattaaagataaagttgaagttaaagaaattggtgaaaaccgtagtaacttagaagttcgatttgcaaaacgagttctaggtattcgtcagatcgaaattcgtcgagatggcgctcttagaatctttgcatacaacatgtcagaaactgaatcaaagctgtttacttctcttgaaaatgatgttaagattaaaatcggtggtaaatatacttacattgacttccctaatgtgtccaaagaaatcattacccttgtaactaatgtactgtgaggaatacataatgaataagctgaatattattaacgaacttcgtaaatgtgcagaacctactcaagaaggatgggatatttggtaccacggggcttatttagggacaattgtaaagattaaagcaggtcaatatacggttattcgtgaaaataatgacgcgccatttggccttcgtaaaaactacatggcagcgatcagttcatttgttgatgcagcttacgaaatctataaagaagattataaagaatatcaacagtcacaaccggttattcgttcgattggtgtaaataaacaagcacaaaaatctatttggcaacgtattaaaggatggtttaaatgaaaacttttaaagaacgtttagctctgttagataaagctttgtcgcgtgagactccggaaagtctggctgctaaattagcttcttacggtggtgaatacacagaacaaaatgttttagatgaagttcctgaaatctgttggcagactctgtattgggatgaaaaccaaaagtatcaacgacgaattgtctgcgcagccaaccgttttaaattaaaagatggacgaactcttattattccaggtgctcgtcattattctaaagatatggcagaagttttagatgtagttaaacctcaattagttactcaacaagtttgtgatgatgaccaagggtttattgaccaatatagtaattattggacacgtgaagaagcaatgattattgcaacttacgctggacaagtacgtattgaacgtggtggtaatgaaaaagaactttactctgaggacctttactaatgaatcttaaacaactccagattgatgctattgaagcccacattaatcatatcaaacgccttaatgctatgatggaagaaaattatggtatgtatgctaatcagcctggttgggatgctttagaccatccttatttggttaatttatgtaaaggtgatacgttagcaattattcgtgatgggttaaaacctttcttgcgcgacatgtatattaaaatgaacgaagaaattattggctcgttgcaatatcaattaaggaaattagatgatgagaataattgattctaaagcagattattttaattctgttaatgataagaataaagctttaattcgtcactttattactgagatgggatatactgtctctaaagatttgaaagagcacattatcgaatgttctgtggctaaaaagttttctttcacagacaaatgtttaaatgaggttataaatcattatgaacaatcttgtagcaaaacacgatttcaataaggcttctgtccataaggacaagaagaaatcagaacttcaatctaaacgcaaacaaaaacataagggtaaagactatgcttactaaaatcaaagaaaatcctgccactgaacttgttattcgttgtgaagaacttgcagagctttatcaggttaacagagaagtgtgtcgtagtgttatcgtagatatggcagacgaagtatgttctcgtattccttttagtgtcgatttcaatcacatgaagcccggtgaaatcactatcgtctttggttctgactatactgaagaacgggctcttaacgtcctagaatatgaaatgtcgtttttcgacatacaggactatattgatagttataaggaacgatatgagtcataatcttcagaacgtagtagaggccgaacgtgagcgtgaggctttagtctataatgaactattagttcaattcttggtcttacactcgtatgaacaggaagactataccaattacgttaaaagcgtagaaaaagccgtttacaatcaacactgataatggtactatatccatatcaactaagtggaatgaataaaacgttatgaataaagacattgaaatcgtacgtgaaattattactattgcttctattttgattaaattctctagggaagatattgttgaagaccgagcaagtttcatcggattcttgaatgagattggaattaaaaaagatggtcggcagctaaatcagaattcgttcagaaaactaattacaaatttaactgccgaagaaaagaaaacactgattagtgaattcaatgaaggttttgaaaatatttatcgtcatttagcgatgtattctaacaactaattatttagcccttcctagtattcggaccgcttggttgcatatagccgctaagcgatcttcctcaagtatattattccccttataccaatacatcgtcacagttccagcatagatgttatccaaattaaagtatggacaactatacatataagaaagttcggcagtcttagattttgtaggcaaaaatgcaaattctgatttagatgagaaatgacggccacttaaatgaattatatattcattggccgttttatccaccgggaatccgccaagggacttttcagaaattgtgctaggtagtttgccttcataagctataaggtcgacaaaataatttaagtttttaggtctgaaagaatacacagcactaaaatctgcaccagatgagatatgaactatttgcagttgttctagagccgcagattcaaaacgtaaagctcgttctttttggattatttcagtataagtatcatacttagctcttacataataatccagcaaaatacttcctttgtaccatattagtgccattaggaacaaaagaataattaccgctactcgggacattaaaacctttccagtagcgttatctttgaaaatacgatctagcaacccaaatagaatatcactaggcgaaaatgacacttttggtgttgccataatacctccttacttaaagatatttataatcgctttgataatagatttgttttcaaggtcagggaatttagggaattcgccgccaagatgttcatgtttttctaaaagggcaaagaattttttgagctctttaaattttcgtttttcttctctattagcaacctctgcgtcaataagagaacttaaaacactgaataatttatagagttcatgaattttcttatcacgttgaactacgcgtttatatgcttcatcttccttccacccgtcgtcggtccaaatgtcaaattcaccaggttcttctgtagtaacattttgaagagcacctggagtgtcaataacaattttttgcttatcataagtccatactgtttttccacgatggtcttcaacatatacccattcttgttcgcgttcatcgaataaaacagcatagccttctttagggtctaaaggtttttttggtgttgaatgagccggaaatcctacgccttttaatggtttataattttcttctttgtaaaattctttagtgtcaaaataataatgatagagtttcatattataaaaagggaccgaagtcccttctccttatgctaaacgaacgatatagttaaaagcaacgtttttaactgtgttttctgtatttcctgtggcatttacagttattgtatgtccatgggaaccaatcgctaccgaatgagagtgggcaccaatacctacagtatgtgtatgggcaccgatacccacagtatgagcatggttacctgtggtacttgtagttcctgaccaactatgggtgtgggcaccgtctgaagaagttttggccatattcgacgatgcagtagcaccgctcacggttgcagtgaatttagcgttgccgtttggacccgcactattgtatccatcatagaatatgctagcgggtatgccgccttgtacctgaggacctgaacgcgcgtgttggtgcgcaccagcggaactagtattaccactcactgtatggttatggttaccagtggtattactggtcttagtaccataatcaaagcttgaagtagttttgctgccgtaatcaaaactagaagtggtcttagtacccaaatctgtgcttgatgcacttgcactatggctatgtgacttaacaccgtctgcttctgtactcaatacagcacgcccagatggtttacccttgatagtttgaccacgcatatcaggcagagtgccggaaggatacaccgcagctaacttaggatacaagtcagcatcaaatgtttgaccttccattatggcataaccttcaggaggtgtatcagtaggccaaggaatcggagcaccaattgggtaacttgagacaatatccgtcttaaggttatttattgttgtattcaagttagcaaagttgccagaaccaccggtgatattaccgtcagtaccgaattgagcattaccgactttaagaggtttagctatatcaaccgtatcagagtttaatgcaataccatgggagtaggtgtaactgtgcatacgaacgatgttaccgccatcgccaatacctaaataccatttcggaacatctgctttacgtccttggatgaagttagaagattcttgtgttggggcatttattctaatagcatcggaggcagtattaactgtaatacgttgccctgatgttgttccactagtttctactttaaatcttccaccaccgatatcaacatcatgatccatgctgactttaccatcacttaatgcaatatagaacggacgtaaattagaaataccacctgattcaccagcattctgcggagttggaataatataaagcttatcttcagaacgacggaaaatagccccgtattcagcattccaaattcttaatgcatcagctgttccaccaattttaacttgtccagtaatagaagaaccaccttggacaaacaaaccgttagacatagtaacattgccaccaaaagaacctgtaccggaggcacttatattaccaaggcctatgatatggcctgtttcgacagttccgttaaatttaaagttaaccggacctactgtttcaccagaagccgggttggtacgttgagcataaaaataataaccttgtgaatctgatacttcaaatacagtttctctattacccttttcagcgttaaacgagttaccccatgctttaatggttacagtatttttattctgaccattacgagtacctgcatcccagttaatggtttttgtcccgtcaacacctgtaggcgctttaaatgtcaaagcattggtattgtcatcacctgataaaaataacccagtacgcattgaaatacgttgggttgagtcaaatgtaccatctgctctaatagcaaccctatttgaactggttttaatatctaaaatgccaggctcaacaagaagtccatcgcccatactaacggacatacgacctgtaccacggaaatagtgatacatcttggcattgctgctataaccgatatgagtctggccatcgccgttattattaccatcaacatcggtacgcgcagtaaacattgcttggttgttatttgggtaatcccaagtagtaccagaatcgcggctataaccaaccatcaattttttagtactgttaataccgttattacgaatagtgccgccagaaataccattcgcaactaaatcgataaccccgtcacgaacccatttaataccagtatcattgtcaccaattgcaatacctttaccaaacgaaaccaatggataacgtccttggtcaccaacatcagcaagacctatacctatcgaattagcaacagacatacgcccatctgtggtataagaccattgataaacttcagcattacgtcccgtccaatacgaaatattctgtggtttacctgaacgagcatcagcaacttcatggaaaatagcagaagaaacatgtccgcggaatttacgaaggtagtttataccattagtatccaaatccgtttcggttggagtatagtgccaagtcggtaatgaaactaaatcatatgcagtatcaatattagtgtcccaagatttagtgctcacattgatatttttggtaataactttaggaccaattaaagaaccagctttagtttcaatattactttgagtaactaaatatccattagatactaataaacttccggaatcaacttgaaaattaccgtttcgattaaaagtccagtattttgaagtcccggtttcatcaatataatggaatttaaaactaccttcgtttactaatgtaccagcagaaaaagttccatctttatagcgttgtttaatcagtggatggtattctgaaacagaagtagttgaacttaaatctgtaaagataggggctttattcgaatgttggttagcccaagcgccatttccagtggttttaggtaaaaattcaatgtattttcctgcataaacaaactgatttccattgagattatacgtgccgttttgtaaataatcaccagtttgagttacattaccgttaatatccccgcccttagcaaagcctaggctaataatattaccgaggtcatctttagtaaaaagagttcgatcttttaagtttatcgctaattcgccttcggctaattgtgctgcagtaggattaactcctgctactttgcttcttttaaattgtatctgttttaatgtagccataagtcctcttaataatagccgaaatcttgaacagaatctttaattacaatctggtcgaaacgaggaacatgattagcctcagacgccggattctgtgagaaaaagtttggtgctgttaaagtaccagtcatggtatcgcctttacgcaatacacgggaatttgcgttatccgtaacaatatttattcgtccatcaacataatcttttcttgtgagatcatttgctgcaaccggagcagtcatatcgcttcttacttgaccagctgccgacacaacgccttttgtattaatatcaccattacgtgtattgattactacagttctaccagctgttccttgtgatgatttaaaaccaataccgtaccatgaaacaatatcaatatttgctgtaacaaaagtagctgcatcaccgttaccaggaaaaataccgctttggtttgtattgtttatagcatatggtatttgcacgccactgttaaatgttacctttgaagcgtaagtaccaccatttgctttagaaacgaaatcgttatcagctgcctgtggtttattatattctgaatagagtttaaacgttttatacaggacgtcatcacctgctggcattaaagggaaattaccttgatgccatataacagcaccgccagttgtactaccagcttttaaatcggccatagttgtctccttatatgtataccatatttatacaaaaatgggagaccgaagtctccctaaatttattctgacgcttctttaaattcttgtccaaataccttaccagtatcagttgaagattgagtaggtaatgtcattatgtctggagcacttaaagattctgaaacataatttacacgaataccatttataccaaactcagcaggttttgaaacgcttccattacatgatacttcagtgaatataacgtttcttaatccaccttgcccgacttgagctgtacgataacaataaatcgtgaacccgtcagcaccagcaggaatttctatgtagtcttcatatatcttccattcgcctgcagccccatcaaagtttatatccttaaatgaaataggtgaagtagaaggagatttaaagaaacgaatagaaagtcgtgtcgtcccttgtgctaacaaatcagcatcggccattagttggaatttcatataaaggaaatctccaggcttcaatttatacccagcgagaggtgtaataagggatgttgtaggcatccttttaatttcattattagtacctccaatggcagataaaaatgtgtctgtcgattcgtacgtacgtctagggaagccggtagcaccaatatcatcgatcgtgtcgtacacaacatcaagtggtgtactatagtcggttgaagttttcttattactatacttaatatgttctagtgctatagcattcttaccagaaatataaaatgccgaataagaaatgtccactatatttaaaacttgttgagctaatggaatagcagaacttccggctttattaaaccatgcaagaacttctggcggaaagtttgttttagcgttagtaacaagagcaaatataaaatttgaagcatatgtgtccatgaaagtaacaaatgcacttgacgtggcgtcgttttcagtagagaaattatatgtcttagattcaactactgcacccgttgtaggatttattacacgaacgtttaatccaatggaaaaaacctgggacccaagtggattatcctggaacttaatataagcaggagatgttgatagcgggcaagagcccgctatgcttaatttaaatcgtactgaattactttccgataaaaatggcgtttggacgtatccttgtccaaacttagccataaatttttccataatacctcttattcaatccacttgaatttaacagatttattcacagggtctggaataatgcggacattaccaatccttaagaaatcccttattgtcaagtttccgattgttgcattatcagaaggtaaagcaccaatatcagatggctgaggagggttacccccatcaaatacttgaacaaaacttgaccaagaatttttagttttctgccatgtacgagtccaacgggttgtacgtgcttctggggttgttggataagtaatccaatcttggtaaagtgaatcaagtgtgttaccaaactgagtcagtgtaccaggagatttaacttcttcgccacgttctaagtatggaagcccagtcacttcattagttttttcaaccattttaaaataacctgggaactggttataagtggctgaatcgttaatatcgattgaccagaatcctacagtatcagatgtcggtgcgagggtatataaatcggatgttttagtaccctgagaacgaattctcgagttaacagttaaaccgcctgaatttatagtagcacctttggcaatgattaagctttcaccaatcgtaacttgaccggattgattattaattgataatggacgtaatccattaaatccaccggtctgatcaccagatgcagtaagcataaaatatgtgctgccgccatcattgcgaataaagaatccgtaatcaccactaattgctctaaatgcatttgcagacttgctaatgaattcgccattggctgtaactgaacgaccaaatgttgctacaccattcgcatttaacgtgcctgaagcgttaacatttattggcatcacagtaccattaatgctaaacgttatattcccggctttattacgttgagaataaaagtgattagatgtttcatcgccaacttcaaatacagtagaacgtgttgtatctgaaccaccaccaaattcatttccccaaactctgatagtcatcgtctgtgctgggttagttccagtttgaggtcctttttcaaaaatcagacgagtagctgttccagagttagaaatagttaatgtactatttgccgaaactgaaccaccaaacgtagcagtactagatgatacaagaggggcactcagattcgtttgttgggttaaggttagtgaaccattaaccgtctgtgcaatgtccctacgaatgaactgagatgaatctaggccatctaataaatttgcgtcagcagcttttgcttttaatggcaaatagttagcaagtacacggtttaattcatacggagaaatagcataactatttttttcatatgattctaaaggttgtgttgaaccaactgtatcattaccaacgaatgtaattgaaccagatgaagttttaacaaaacctcttattgcagtagtagcagcccatgtcggttcattctggacaatccattttaaattcttaggagatacagcagtattagcagaagttcctgttacagtttcagcctgagtagcaaccttaattacgccttcagacgtttcagtggacttagtccctaaaagctttttaggagtaataagaacatcatctaaagttcctgcattagattctgcttgggtcgctacacgaagtgtaccacgttgtgtttcatttgctttagaaatatcaagagtataatggttccacaaggttccttcttcaataagtccggaatcagaattaacactggtacggtcagaagaatcaaaatgagttttaattttcagtggagttgagatacgagtatcatcagttccagtatcaaattcgacttgcgtagcaagttcggctatgccggataatccttccgtagctttcctatcatttaacgtcttaggcgttactgcacgtgtataatcagtcccagcattagtttctgtttgcgtagcaatttcaattaaaccaatacgtccatcagtagaagttttcttatgtagtgtttcaggagttactacagcgtgagaataacctgcttgtgattgaccagcaattacttcactatcaacagctaaaattactgcaccttgttgagcataagttgctttatattggtcaagggctttaggagaaatagttaaattatttacggttttattataaacgttagtgcctgcagcaccacgagtttcagcaggagtagcagaagtagttgatacatatttaactatacctgatagtgtttcagaaccctgacgtgcctgcaatttcttaggtgtaataatcgttgtgtcatcaagaccagcatcggtttcagtctgagtagcaatttcagcaagaccgcgtcgagtttcagttgctgtacgctcatttagttttttaggcgtaacaatagtatcgtccacaaatgatgctgtggaattctggttaacttgtgctgttgtagcaattttagcgataccacgtcgagcttcagttgctgtacgatttgccaatgtttccggagtaatagccacttctttagctggagtattctctaaatcaacatttgcttgcgcttgagtagcaagagcaataacacctaaacgagctcgtgtagcatcatttccagcatcaacacgttctaccgtagggacattctgttgcacaacccaatagtgagtgtcagaatcagtgtcttcgatatacgctaattctaatacaggaacatatgaagtagtgccattgaattctagttcagtaacagagacccattgagcatcaggtggatattcagaacgtttagggaactgaagcaatgcaacagaagaagcaattgtatcaccttcggcagctttaatttttactgtttggcctttacgcatgtagttcattgaaattttaacagtgtcaccactcaaaattccggtgggcagcgtaagattaatagttccagccgtagcgttatttgtgccaaaaataagaacttcttcatttggacgaatatttgaatccgcacggataatacgaagacgcgatttctggtcgccttcccatacacgccataaactacttgcagcatcaaaaacaaaaaacgcgtcagagtcatttctgccttcggcaatatgagtcccgacttcaccaatagacgttgtatcatcaaatgttttaacaattgtatgatacagtgggtttaatttatctaaatcaactatgtggattatatcaccattattagcattacgtggaagtgtaatgttgattggtgctgcactagtaaaacgacgaacgataaaatcatttgcttgtgcttgatatggtgtcgcaggtgtaacagtgattgattctttaccataatcggtaatatacatctgccacaaacgattactaaacacaaacaatagttgtgaacgcggacgcgtcattaaaactgtacgaacttgttcacctctaaagtttaaaatactctgcacagacgcgttaatctgtactttaactgtcccggttcttccaccaatatcagccaaaacaacagtatcaccatcaaccggcgtatttggcaacgtgaaaaccatatcattgccggcaccagtgttaaccgaaatagattcacctgaagaaagttgataagtcccagaagcgacagttatccattgtgcatcagtacgaactgcacgccattgtaaaaggttaaatgccccggaaggagacacgatatcatttattgcttgatataaacggttgtcataaagaacaacaaatcctttgttatatccacgcgtagaatcatatacttgaacggtgttttcttgtaccaggaagtcaacgtttacgccatcagtacctactgtacggtcggctaatgctacgttaacaatcttgtcgccaccggcgtccagaccgtcttcggctctgaacttacgtttgatgtcggccattcgtttttcctttattgtttcaataatacttatttataccagtttacgctttcaaatgagtgtgttactatagtcaagttgactaactgaacaagaggttcatatggatttagaaatgatgttggatgaagattacaaagaaggtattgcacttgccgactttagtaacattgcattggcagccgcattaaacaactttgaagacggcgataaaattaccgttccgatggttcgccatgtaatcttgaattcaattcgtaaaaacgtagtgatgttccgtaagcaaggctatacaaaatttgtattgtgtatggataatgctacttcgggctattggcgtcgtgactttgcttactattacaagaaaaatcgtaaaaccgatcgtgaagcttcaaagtgggattgggaaggatattttactgcactccatcaagttgttgatgagattaagaaatacatgccatatgttgtaatggatattgacaagtatgaagcggatgaccatatcggtgtattaactaaatatttgtcattagctggacataaagtatgtattgttgcatcagatggtgactttacacaattacacaaatatcctaacgttaaacagtggtcgccaccacagaaaaaatgggttaaaattaagaatggttctgctgaaattgattgcatgactaaaattcttaaaggtgaccgtaaggatggtgttgcatctgttcgagttcgtggcgacttctggtttaccagagttgatggtgaacgaactccgagtatgaaaacatcgattattgaagcaattgccaatgaccgttctcaagctgaagtattattaagtgctgaagaatataaacggtatcaagaaaatttggttctcattgattttgattatatccctgataatattgcttcaaccattatagagtattataactcatataaacaacaacctaaaggcaagatttattcatattttgtaaaatctggtctttctaaattaacaagtgtaattaatgaattctgaggtaaacatggctaagaaagaagcagttgaatttaatcaagatgtgcatggtgaagaactggctaaactagtcaaggaagcttccgataacaaacttaaaatttctggttataatgaactgattaaagacattcgtactcgtgctaaagaagagcttggtgtcgatggaaaaatgtttaatcgtttgttagctctttatcataaagacgctcgtgatcaatttgaagctgaaaacgaagaggtagtcgagctttatgacacagttttcactaagtgatattaaaccggttgatgaggccggtttatctgaacaagaattagcagtaaaacacgataaagatgatatcgctaaattgcttgaccgacaagaaaacggattcattatcgaatccatggttgaacaatttggtatgtcttatttagaagcaacaactgctttcttggaagaaaattctattccagaaacacaatttgctaaatttattcctacaggaattgttgaaaaaattacaagcgaagcaattgacgaaaacatgcttcgcccatcagttgctcgtggtgaaaaaactaatacgttagatttcttattatgattaaaatacgcatgcctcctgatggagaacgttatattaacggaaaatcggtatacaaactatacttgatgtgcaaacaacattttaatggtcggtatgacgtaatcaaatataactggtgcatgcgtgtttcggataatgcgtatcaaaaacgccgagataaatatttctttgaaaaactagcagagaaatataaattgaaggaactcaccttgatattcataagcaacttagttgctaaccaagacgcatggattggtgagatatcagacgctgatgcattagttttctatagggaatatattggacgtctcaaacaagctaaagagacgtttgctgaagacgtacgtaacatctactatttcagtaagaaagttgaagttagtgcgcttcaagagatatttgattataataacaacgttcagtcgagctacatattcaaattgctacaaagcaatataatttcatttgagactttcttattgttggactcgtttttgaatattatagataagcacgacgaactcaccgataacttagtctggcaaaattattctatcaaattaaaggcatatcgaaaaatacttcaaatcgatggaaatgctgctaagaaattgttcatagaaacaatcaaatcatgtaagtattaagctttattttatctgtgttagaattaccgtataaataaaacataccagctacgaggtataagtgtcgtagcaaccaactgtaaaatttaattaataatctaaataaaggcaaataaaatgtttaaacgtaaaagtaccgcagacctcgcagctcagatggctaaactgaatggtaacaaaggtttctcttcagaagataaaggtgaatggaagctgaaactcgatgcatccggtaatggtcaagcggtaattcgtttcctgccggcaaaaacagatgacgcacttccgtttacaattcttgttaaccacgggttcaagaaaaatggcaaatggtatattgaaacctgttcatctacacacggcgattatgactcttgtcctgtatgtcagtacattagtaaaaatgacctgtacaataccaacaaaactgaatattctcaactgaaacgtaaaacttcttattgggctaatattctggttgttaaagaccctcaagctccagataatgaaggtaaagtattcaaatatcgtttcggtaaaaagatttgggacaaaatcaatgcaatgattgcagtcgatactgaaatgggtgaaactcctgttgatgtaacttgcccgtgggaaggtgctaactttgtgctgaaagttaaacaggtttctggtttcagtaactacgacgaatctaaattcctgaatcaatctgcgattccaaacattgatgatgaatctttccagaaagaattgttcgaacaaatggttgacctttctgaaatgacttctaaagataagttcaaatcgtttgaagaattgaatactaaatttaatcaagttcttggtactgccgctcttggtggtgcagcagccgcagcagcttctgttgcagataaagttgcttctgaccttgacgattttgataaagacatggaagcctttagttctgcaaaaactgaagatgacttcatgagctctacctcatcctctgatgatggcgacctcgatgacctgttagctggtttataataaattgggagacttcggtctcccttttgagtatctgtaaattgccgaaaaagttgtttacttcttccctggatgtgttagtatagacctatcaacaacatgaggaaatcaaaatggaaatcggaaaatcttatatcattaaccctttatttaaagacgactttgttcaagaagcaccacataataacgctaagatgttaaaattgattgaactccacgggcctagttttgttgtaaacggaatggaacctgattatgatagcgatacgtcaaacgtagtaagtgtaactatggaagatggtactgtatgttctgccggtggtgaaattgaaacttattttgagatttatcctgacgagttcaaatactttactgaggtagatttagtaaagcctcaacctactaacgaaggtataactttaggtgtaacaaaaatacattgtatcgtagatgaaaccaacgtcgacgaaatcattgaacttttgcaaaaaacttttaaaaagtagtttataacaagatagggctatgttatagtagccctatcaaataaaagtgaaggagaataaaatgagattacaacgccagagcatcaaagattctgaagttagaggtaaatggtacttcaacatcgttggtaaagacgctgaactccttgaacaagctgaagaagctttacgtgaaatgggttggaacgaagaatgtgatggatgtccactctacgaagatggtgaaagtgcaggattctggattcaccactctgatgttgaatcgtttaaagctgattggaaagttgttaagaaaaatctgaggaaataattatgaatgttgttgttgaatactctcaaggcgctgatgtcggatatgaagtttatacttcagttaatttagaccatccggatttggccgaattcattggtgacgcatttgatttgtctgggcgatacacaacaaaacctcgcgtttgtgttataatatttgacccgaccgatggctgtcaaatccagactgatttggtttcttctaaatcacaaatccaaaaagttattaaaggacttaaaaatgcttaaattagtattcgcatgcgcaccgtctaaaacagttgatgataaactggaatatgcttttggattaggtgatggacttccatggaagcatatcaaacaagatatgagtaactttgttgctcgcactaaaaacactgtaatggttatgggtgctaagacttttgcatcattacctcgtctactaccagatcgtactcgtgtggttgtcactgatatggccagaaaactgcctaggactaaaactgatgaacttgcacggttctatatcacccaatctgaatttattaccttggtaatgggtggtgaaattaccctgtttagccctgcaactgacgtaccgtttaaactttctactgaacatgttaatgtatctgttatcggcggtcctgctctacttaaacaagcactgccttatgccgatgaaatcgtgatgactaaaatcattaagaaatgtcgtgttaattccgatgttcaacttgataaagatttcgtccaagatattatgcttcaacgttctatggtagaatctcattactacagaatcgatgaactcaccgaaattactgagagcgtttataaatgaaacaataccaatacctgattaatgatatcctagaaaatggctacgaaacagacgaccgtacaggtaccggcactattgccctgttcggaactaaattacgttgggatctgactaaaggattccctgcagtaacaactaagaaattagcatggaaagcttgtattgccgagttactgtggttcatgtctggttctaccaatgttaatgatttgcgtattcgtactcatggtagtcttattcaaggtaaaactatttgggacgacaactatgaaaatcaggcaaaagaccttggatatcatagcggcgaacttggtcctatttatggtaagcaatggcgtgattttggtggtgtagaccaattggtcaaaactatcgaccgtattaaagctcttcctaatgatcgtcgtcaaatagtttctgcatggaacccggccgaaattgaccaaatggctcttcctccttgtcatatgttctatcaatttaatgtgcgtaatgggcatcttgatttacaatggtatcaacgcagtgtagatgttttcttgggcctgccgttcaacattgcctcgtacgctgccttgacgcatattgtagcgaagatgtgtaaccttatcccaggtgatttagtgttctcaggcggcaacacgcatatctacagcaatcatgtagaacaatgcaaagaagttcttcgtcgtgaacctaaagagttatgttctcttgaaattaattggcctagtaattttgagaattggcctacaaaaatccaaatggactgggttactggaacgatgacacattctgatttcgttcttaaaaattacgaatctcatccaactatcaaagctaaaatggcggtataaatgattttacgttttattaattcatatggcaccacaatttttgaaatgaaaaatccaagtgaactggatatcccttcaccaaatagtgaaatcacagttaaaggtgaacgattcatttgttattcacatgaacgaatttatgaatatcgtgaattctgtggtggattcggtatagaaaaagaaccgttggtttattttaatatcacggtcttgactcctaaagaatacgaagaaattattgcagaggacatgtaatgaaaatgtgccgcgttgtgaataaatataaatccgattttgatgttaatattcatcgtggcacattctggggaaattatgtaggcaaggatgcctcttcccgagaagaagctattgagcttttcaaaaaggattttattaagagaattaagtgtggagaaatcacaaaagctcatctagaacctttacgtggtatgcgtctgggatgcacatgtaaaccaaaagcctgtcatggtgatataatagctctagtggttaataaactttttaaagacgaatttaatatagaggacatatgcaagtaactaagagcagtggtgtatcacaaaattttgatgcacagaaaattattcaagtcttaacttggcaatgtgaaggaacacaaattgacccatatgaattgtatgaagaaattaagacccatcttgtcgacgggatgagcaccaaagatatccagaagatttgtattaaagttgcagctaactcgatttctgtcgaagaacctgattatcagtatgtcgccgccaaagggctaatgtttgcacttcgtaaagatgtatatgggcagtttgaaccgcctgcttttatcgaccatatttcttattgtgttaatgaaggcaaatatgaccctgagctgttgtctcaatattcagcagaagaaatcatttatctcgattcacagattaaacatgaacgagactttgacctgacttatgctggtgctatgcagcttaaagaaaaatatctagttaaagataaaacaactgggaagatttatgaaactccccagtttgctatcatggctattggcatggccttacaccaaaacgaaactcatgaccgtttgaaacatattattcgtttttatgatgccgtttctactcatcaagtttcattgccaaccccaattatggcaggtgctcgtactccaactcgccagttctctagttgtgtagttattgaagccggtgattcgttaaaatctattaacaaaacttcagcatcaattattgaatatatttctaaacgagctggtattggtatcaacgttggtatgcttcgtgcagaaggttctaagatcggtatgggtgaagttcgacatacgggtgttattccattctggaaacatttccaaactgcagtaaaatcttgttctcaaggtggtattcgtggtggtgctgctacagcgtattatccgatgtggcacttagaagtagagaacctattagttctgaaaaataacaaaggcgtggatgaaaaccgtattcgacatatggactacggaattcagattaatgaccttatgatggaacgccttggtaaaaatgattatattactttatttagccctcacgaaatgtcaggcgaactatactactcgttctttgaagatcaagataaattccgtgagctttatgagaaagctgaaaaagacccaacaatcagaaagaaaagaatcaaagcactagaactctttgaattgttcatgactgaacgctctggtactgctcgaatttatccacagtttgttgataacacgaataactacactccgtttattcgtgaaaaagctccaattcgtcagagtaacttatgttgtgaaatcgctattccaactaatgatgtgaatggtcctgatgctgaaattggtttatgcacattatctgcttttgtattagataaatttgattggcaagaccaagataaaattaatgaacttgctgaagtacaagtacgtgcacttgataacctgctagactatcaagattatccggttccggaagctttaaaagctaaaaagcgtcgaaatcttggtgttggtgttacgaactatgctgcatggttagcttctaacttcgcttcatatgaagacgctaacgatttgactcatgaattgtttgagagattgcaatatggccttatcaaagcttcaatcaaactcgccaaagaaaaaggatgttgcgagtattattcagacactaaatggtctagaggcgaattacctatcgactggtacaataaaaagattgaccaaatcgcagccccgaactacgtatgtgattgggaagaacttcgagctgaactcaaagaacatggaattcgtaactcaacgttgtctgcactcatgccttgtgagtcaagcagtcaagtatcaaactctacaaacgggattgaaccgccgcgtggtccagtgagtattaaagaatctaaagaaggcaacttccgtcaggttgttcctaatatagaacataacatgggtctttacgactacgcgtggaaacttgctaagaaaggtaataaaccttatttgacccaagttgctatcatgttgaaatgggtgtgccaatctgcttctgctaatacttactatgaccctgcagtatttgagaaaggtaaagtgccaatgtcagtaatgcttgacgatctgctttacttctggtactttggcggaaaaaacctctactatcataacactcgtgatgggtctggtacagacgactatgaattagaaacacctaaagcagaagattgttctgcttgtaagctttaagactttttattataatttactcatggatgagttaataactaagtgagaaatataatgagtacagtttttaacacacaacaagtcgatgttttgaatgaaccgatgttctttggttctggtcttggcctcgcacggtatgatattcagcgtcataaagtttttgaagagcttatcgaaaagcagctctcgttcttttggcgtcccgaggaagtaaacttgatgttggattcggcccagtttaataagcttccacagttccaacaggacatctttaccaacaaccttaagtatcaatcattattagattctatccaaggtagagcaccatctgcggtacttatgtcattgctttcagacccttcattagatacatgggttgctacatggactttcagtgaaactattcactctcgttcatatactcatattatgcgaaatctttatacagatccatcgaaggtgtttgatgagattgtattagatgaagctattatgaagcgtgccgaatctatcggacgatattatgatgatgttctggttaaagctcgttattgggaaaacgctaaagctgatatcgaataccaaaaagaaattaatgcagacgaagacgttattgaagatgctattgagcatgagacatattggaagcgtgagctaatgaaatctctttacctctgtttgcacgttattaatgccttagaagctattcgtttttatgtatctttcgcatgcacctttaacttccacaagaatatggaaatcatggaaggtaatgccaagattatgaagttcattgctcgtgatgaacagctccacctcaagggcactcaatatattattcgtgctttacaagatggcgaagacggtgatgaatgggtcaaaattgctcaagagtgtgaacaagaagcagttgatattttcatggaagttaacgctcaagaaaaagaatgggctgaacacttgtttaaagatggtgctcttccaggtctaaatgttaaaatcctaagtgaatttgtggattatcttaccgtgtctcgtatgcgtagttgtggtctgccatgtcctcttaaagacgtatcaactcgtcatcctattccatggattcgtgaatatctgaactctgatttagttcaagcagctcctcaggaagttgaaatcagttcttatcttgtcgcacaaattgataatgatgtagaccaaaatgtaatcaattcatacaaaaaatatttctaaggacgggacttcggtcccactttattatgaaagatatcgccgccgaatattcctttattaaatatacagaattggagctattagaagatgcaacaattaaaacagttgatgtccctaataagaaaaatgtcatatatgctattgctatagatgacgaacttgtgtatattggtaaaaccaagaatttaaagaaacgcattaactattatcgaacagccataaatcgaaaagaccagacttcagattcaagaaaatcacttatgattttggatgccttaatgcaaggcaaaaaggttgaattctgggcccgccaatgttttgacctttcagtcaccaacgaacttggttcaatgaccatcgcaacaatggaccttgaagaaccgctttttatcaaaaagttcaacccgccttggaatatccaacataagaaaaagtagtttacataccacaaggattgtggtacaatttaaaaaaactaactgaggatacaaaatggaaaagctttattataatctgttatctctgtgtaaatcgtcatctgatcgtaaatttttctactcggatgatgtaagtccaatcggtaaaaagtatcgaattttctcatataactttgcttcatattcagattggttattgcctgacgcgttagagtgtcgtggtattatgttcgaaatggatggtgaaactcctatacgtattgcttctcgtccaatggaaaaattctttaatctaaatgagaacccgtttacattgtcaattaaccttgatgatgtaaaatatctgatgactaaagaagatggttcgttagtctcgacatatcttgatggtgggattgttcgtttcaaatctaaagggtcaatcaaatccgaccaggctgtatcggctacgagtattttgttagacatcgaccataaaaacttggctaatcgtttgttagaactttgtaatgatgggttcactgctaacttcgaatacgttgctccaacaaataaaattgttttaacataccctgaaaaacgattgattcttttgaatattcgtgataacaacacaggtgaatacatcgagtatgatgacatttatctagaccctgtttttcgtaaatatcttgtagatcgatttgaagtaccagaaggcgactgggcctcagatgtcaagtcttctacaaatattgaagggtatgtagccgtaatgaaagacgggtctcatttcaaattgaagactgattggtatgttgctcttcatacgactcgagactcaatctctagcccagaaaagttgtttcttgctatagtgaacggtgcttcagatgaccttaaagcgatgtacgcagatgatgagttttcatttaaaaaggtcgagctcttcgaaaaagcatatcttgatttcttagaccgctcattttatatctgtctagatacatatgacaagcacaaaggaaaagatcgtaaaacgtacgctatagaagctcaggccgtttgtaagggtgcacagacaccttggttatttggcatcattatgaatctttaccaaggtggttcaaaagagcaaattatgactgctctagaatcagtctttattaaaaatcataaaaatttcatccctgaaggatattaatggtttacaaacaccaaggaaggtgttactatggcttttatcaacaacacgaggagaaaattatgaatatgcaattgattactaacgatatggtcgtaaccgcttttggagacacaactgacggaatccgagtctttaagaaaggacgtccagttggttatcttactgacctacgtgttacactggccaaaaatcttaaaaagaaagtaaaacaaaaagagtattcaacccgatacgctgaagagaaacgcgaagcgatgccagaagcagttaatgctatggtagaatttcttcaaaacaatttgactaaatatgacgctaatgtgttcattaatattagtcaaccaaacgtacatatcgcaggtatcaaattctatattatttgcgaccctcttaccgacaaattcaaccgcctcggaatttcaagtccatatcatacagcagaagagttgtgtgtattgtttgaatcgtacaaaatccagtgtgatggtttgaaaaccgttcttatcaatggattatcccgagatgaaatcattgagattattaaaacatgcttaaagtaaatcctatttacgctatagtagcagcttttgctctagtttctacggtaacaatagttgtcttaaacaacaaagttgattcgttgaatactgaattagcttctgtcaaagagactgctaaaaacaatgctaaagtattagacgacttcaagattcaatatcagtcaatcgaagaaatgacttataagaaccgtgttttagttgaccaacttaaggctgaaaatgaaaagctccgtaaggattcgaagaagaagaacgtggtggcaagtaagccaggattggtcgaaaaacaaatcaacaggtccttcgattcctttgcagaagacctcaggaagctctcagaatgattaaattaaccgcagttgtattatctattggcattttggctggatgtactcaggatgtgccagtaagccctaaagaaactttacatccttcatggcctacgcctatttccgaatacaaccagaaatggcaagtaaaggttattgatggtaatccgtgggttggaatgccatttgaagactctcaagaatttcgtatctggttaaacgacgtaaaaagatatatacatgaccagaagactatgttatgttattatcgtagtggtttaaaagaggaaaaatgccaatgactaaagaacaacatgaatacattaaagggcttatctatgaatctgaaatggctgctatgatttatggacgccagattcaacgattagaatctttgcctccgactaatgaccgcttgttagttcagtctcgtgctaatctgaaaaatgaatatcagaataagtgggcagtagcgactaaagctcttcatgagtatattgaatctttagtaaaatagtttacaaactctcgggagcagagtataatgctcctatggataattgaggaaatctaaatgaaaacattactagagaattacatcaaacggtctgatgagtatattgatatctgccgtggaatgacacttgtagattatgacaaagatgcagcaaaggcactagatgaagcaggtaaagctcttcgtaaagctgctaaagaaaaagggttggatttgcaacaactcaaaagtcatatgattaaatttatttcttcaaacgttagaagtacgtcaattaataaaaacgttgctgaaattaataaagaccggcgcgagcataacattcgtattcttgaaattttcttaggaataaaataatggaccaagccaaaatcgataagttaatccatacgcttgtagcagatattaacacacgtgctcttcgtaaatcacagaacggtgattcttggactatgcaagattgcaagaaaggtgctgaactaggacgtgaaattgctaaaattcttggtggacaatttgaatttgctgaagaggtagtaaaactgtgaaaaagattattttgactgtaggttgtcctgggtctggtaaaagcacttgggctcgtgaatttattgctaagaatcctgggttctttaatatcaaccgcgacgattatcgccaatccatcatgggtcacgaagaacgtgacgagtacaaatatactaaaaagaaagaaagtatcgtaacttatatgcaacacgatgcggcacatatgattctctgtcaagatggaactaagggtgttattatttctgacaccaacttaaatcctgaacgtcgtcttgtctgggaagaatacgctaaacagtggggtcatgaagttgtatatcaagtgttcgatgttccatggactgaattggttaaacgtaacgccaagcgcggcacaaagaccgttcctattgatgttctacgttcgatgtattcacgcatgcgtgaatacaaaggacttccggtttataaaggaactccgggtaaacctaaagcggttatcttcgaccttgatgggactttagctctacatgttgctcgtggaccttatgagttagataaactatccacagatgccccgaaccctatggttgtcgaatatgttaagatgcttcatcaggccgggtatacaattattactgtaagcggacgtgaatctggaactaaagaagattcaatgtgttattacgaagcaactaaaaaatggatggattcgttttctattccatgggaaatgcatattcaacgtaatcaaggtgacactcgtaaggacgatgttgttaaggaagaactcttttggaactgtattgctccttattacgatgtgaaattagccgttgatgaccgtaaccaggttgtggaaatgtggcgacgtattggtttagaatgttggcaagttaaccatggtgatttttaaatgaaacgattatatgaagtgattgaggccatcgaacatcataaagaatatttgtttgtagcctggcctttagtaaatggacagttcggtattgatgtgctggactatgagcatgaagaacgtttggacggcggtatatttgataacgtcgaccaggcaattgaatggttaaatgaaaactatgtacgataaacatcatgaaatcgaagatgaagcatacaaaatgcttcgtaaactagtgggacttaatatgagtcctacattaatcaacaaactcgcaggaattcgtaatgatctgaatactcgttacaaaggcgaatatcatgtagagtttgttcctgtaggtgaaccgaccgagcgatttgttgttcgagttaaagtaaatactgtacactgaggtaattatgttcccaacttattctgaaattgtaaaggtagtcttcagtcagattattgctaataatatgtttgaagtgcttgataacgcagccgaactcagagttcatgttcaagtaactcatgtacttaatgctttgctcccagaccaagtagattctattgctattactcttctccctggatctgcacacgtcatcgtggtatttgatcttgacggcgatttagttatccaatgtgatatcaatttcggtacacaaaaaattgaatgcaaagcaatttaatggtttacaacgcggtggagttgtgatatgattatctctaccgacaaatgaggaaatcgaaatgctaagtgaaaacccaattacagtacacgaatttcagattaaagtaaaagaatttgctcaagcactcatcaataaagtgtctgaacgtttccaagatgcaacattacgagttattcaagaatctccacgttcttttctcataatcgttaatcctaaagatggtgaccagattactagccttaaattaggcagtgacggtttagttgaagcaactcgcgtatacggaacactataatgaaagctagcacatatcttcagattgcttatctgatttctcaagaatcaaaatgttgttcatggaaagttggtgcggtcatcgaaaaggatgggcgcattatctctacgggttataatgggtctccttcaggtggtacaaactgttgtgaccatgctaccgaacaaggttggttgaagaataaaccaagcccggtcatcgttgctgggcataaagaaggcactacagcatttggacgggtggataattttgttttggctaaagaacatcgggccgctcatagtgcatggtctgctaataacgaaatccatgctgaattgaatgcaattttgtttgcagctcgtaaaggtaattctattgaaggtgctacgttatatacgacgctttctccgtgtcctgattgcactaaagctattacacagtcaggtattaaaaaggttgtatacgcagaattatatgacagatctcctgaaaattgggcagacattctaaaacaagccggtattgaagtaattcagtactctcgtaataatcttcgttctctgaattgggaacaaatccgaaacttttgtggtgaataatatgattttaactgaacaagaaactatggttcttcgtgaacgtattaaaactattctgtctgtaggcgttcattgtgttgtatttgaaaaggctaacggtgaggtacgcactatgtttgcttcgcgcgatgaacttgaagtcaaatatgaaaataacaatccggcaacagaagttcgttctgaacctcgtgaatcagttcgagcattcgataccaagttaggtcagtggcgttctttccgccttgataaagtaatttcggttgatggtactccggtagaacgtttgcttcttatgtaatatgctttacgaatagtatggtattattaatctatcgtcaaacaacaaggaaataagatgtctgaagtacaactcccaattcgtgctgttggtgaatatgtcattctggtttctgaacccgctcaagcaggtgatgaagaagttaccgaatcaggacttgtgattggtaaacgtgttcaaggtgaagttcctgaactatgtgtagttcattctgtaggtcctgatgttcctgaaggttttgttgaagtcggtgatttgactccactaccagttggacaaattcgaaatgttccacatccatttgtggctttgggacttaaacaacctaaagaaattaaacagaaattcgtaacatgccactataaagctattccgtgtctttataagtgatataaataactatatgaagagaacactcttctaagcggtagcctacaactgagagacttgtcgaaagaaggtgaaattcagacgaacgtggctactaaatattatctcgaattgagaatttaaaatgattaaacaattacaacacgctcttgaactgcaacgaaacgcatggaataacggtcacgaaaactacggcgcgccgattgatgttgaagccgaagcactggaaatcctgcattatttcaaacatctgaacccggtacaggcagctttggcctctgaactggaagcaaaagatgaactgaaatatgctaagcctttggcttctgcagctcgtaaagcagtacgtcattttgttattacccttaaataagttttaggtgattcgctaccttaagtgcggctagaaaatcgaggagccgtcgaactgtctgattaatgatttgcgaatcattatagttttaagaccacggcagttttacggtgtacctcttgaatgtattttgtactatcacgcgtcagaaaaaggttatctgtctaagtcgtggttggtatgatgacgggtttatggttatcctgtcgttaaatatccaaaacctatgttccccttgagggcttgcgcaggcaatgtcaataagtcctgcattttcatttaaagagaatttataatggcaaaacaagctaaagcaaagaaagcagttgaaaagaaagttgatggtacctctaaacgcgctggatacaagcgtgggtcgaactctcgtattaatcaaacagttgagaagatcatgcgcagagcacgtgcagttcttcgagatgatgcttctcgttttggaaaggttgttgcataattttagggagacttcggtctcccttttgtgcgtttagggcagaaaaagtttaaaaaagatgtttactctcctgtaggatgtgttactatagacttgtaccacctaatcgataaaacaaaccggagaacaaaatgaaaatcaatctgaactcatacatcaaatgtaaagaccacgacggttataaagctatcgaaattaaagaattccagtggatgttatacaaagagcaatttgagttcgtaggttgtatgacccctgaaggtccttctgatgatttctcttggaaaattgtgttagcaaactttttcacaggtgacacatacgaattaaaaactattattaccggtaaaattcgttcagaaacatatgttgacgaagaaactggttactctgaagatgttacatggtatcaaaatggacgcattacagcagataacctgatagaaaaaatgaaagccaaaggtgttttaaatttaaacaattggattaaagttgcataaaacagtttactttggtacaggttatgttattatagacctgtaccaacaaacaacttaaacatctggagaataaaatgaactacaccaacttcgaacgtaaatatgtttctaacggtattgctggttcttctgaagttatttgcttatggaaacacgaaaacggtacagtttgtgaaatcgaacagtgcatgactcctaattacgtttatatgcgatttgaaaatggtatcacggtttcaatcacgatggaaggttcaaattttaaaattgcattagatgatgatttccgtcagcgtgatttaggtactcatccttgctggaatggtgttaatcgtaaacttctggttaaaacttggattcgtcatatcctgagtaaccgagctaaacctgaacatctcgaagcaatctttgatgtagttcttaatgaattcgatatctaatttaactgggagcttcggctcccactgaggaaattatgtttaaagttaatactttttataaaatgaattttaaaaatggggatattactccacgccttaaaaacatgttctcatatgaccttattgagccttttgaagttttagaagttactgatgccggctcagtttgtgaaattagaacttctgaaggtaaaatttatcaggccggtgttggtaaattcagtaattgttttactttaatattctcgaccgatttagatgagcattttattgaatgtcctaaccctaaggtctatgaagttccacatcaagaaactaagaaaaatggaccgcacgaatatacgaaggttgaaactcctcacggcgtgatgtggcgacataactctccttttggaagtaaaggaacatttgctcaactggctaagccctacgacgatgaaaaatatgtagtagtccttttatctgaacagggtactcaagaccgtggatgccagcgttccggtttattgagtgaactcgaagctcataacctagcacgtgaattcgttgagaaaaatcctggttctgaagctctagtcatgaaagcaattactcaatatatcactgctcaacctgttgttcatccggtagaaattaatttcgttaagtagtttacatccaaggacggattagagtataatgatttctttagtaagtggaaaaatatgaaatttttaatagcacaaacagtccaattaaaaggtgttggaatccctgggatgatttttaaagttctccatgaatttaaaaccgccgctgtaattatcaatgaagcgtatgctgttcaatgggttgatgggacttctgacatacgtatgggtaaagagttatctcctattaaagggttgaaacatgttgaataaattaatccagaaattgtttggtacagaaatggtcgaagttacttatcgtgtgactgacgtttctccatattatgcagaaaaccgtttagaaccatacgttacgtcaattaaaatgcctaaaaatgacagaaatttatctatcgaagaccgtatacctggatacggacattgggctgatgttgaaattataagtgttaaagatgtctgaattagaaataagaagtaatttcaaatggccgtaatgtgcattaagtaactttgctcaatggccttttgttatggatggtattcaattcggaggtcttgaaggatttctccaaggatgtaaggtgaaaaatgttgaacaacaaagacgtatatttgggctgtcaggactggccgcacagcaagctggaaggtcttacgcaagagctcaggaccgtgggactctcttctggttaggagttccattttcaagatactccgaagcgtggaaagaattatacacaaatgcatattttgaagcagcgatccaaaacaaggggtttcgcaatgccttacaagcctctaaaggaaaaattttgaagcacagcatggccagccacctaacaaaagatgatacaatattaaccgaagccgaatttattgatgtgttaaacctattaagagactctttatgaagcctactattttgactgatattgatggtgtatgtttaagctggcaatctggacttccttattttgcccaaaaatataatcttccattagaacatattttaaaaatgattcaggacgaaaaatttatttctcctggtaaactgttcaataccgacgataaccttggtaaacaattaatagaaaaatataatagctctgattttattcgttacttagcgccttattcggatgctcttcgagttatcaataagctaaaagaagactataattttgtagccgtgacggcgctaggtgattcaattgatgctcgattgaatagacaatttaatttgaatgctttgttcccaggcgctttctctgaagtaatgatgtgtggtcatgattcttcaaaggaacaattattcgaactagctaaaacaaaatataacgtaatttgttacgttgacgatttagctcatcattgtgaccatgcggcagaaattcttaatgtaccgatttattggttggctcgtggtgaacgtgatgccattcctcgtactgcacaacgtgtacacacgtgggatgatattgaatctcgtttggttctgcctaagaataattcagattcagatcgtgaagaccttttaaaacgattggcggatttgcttaaagaatctggtgcaacaagtccaggtgcatggcccaatcaaattggtggcccctcgacaacacgtactccatatacctggcgaaccccaggaccaactgatatgcagccgtggtggacgattcaaaactttcctttagattcgtctaaatggacttggtctataaattgttaagggttaattatgtttgtagttcatgatattacagatggcaaaaataccacacgtgactacggtcacgttaacatgttctttcgagactggccattgtttcgttcagtaaaagacgcagaaatatttaaagagtgtgttgaacaagggttcatctacatttcagaatactatgttgaaggactcggtaaatggattacaacttatcagaaaacgctgaaatcgcttctagatgaagtggcttataatagaaccgtaaccaaaatcgaggacatcaaatgattttagatattttaaaccaaatagctgcgatcggttctactaaaacaaaacaggaaatccttaagaaaaataaggacaacaaattacttgaacgtgtgtatcgtttaacatatgcacgtggtatccagtattatattaagaaatggccaggaccaggtgaaaggtcccaagcatatggtcttcttgaattagatgacatgttggattttattgagttcacattagccactcgtaaactcactggtaatgctgcaattaaagagctcatgggttatatcgctgatggtaaacctgatgatgtagaagtccttcgtcgtgtaatgatgcgcgaccttgaagtaggtgcttcagtgtctatcgcgaataaggtgtggcctggacttattcaattgcaaccacagatgttagcatctgcatatgacgagaaattgattactaaaaatattaaatggcccgcatttgcccaattaaaggccgatggtgctcgttgtttcgctgaagttcgcgatgatggtgttcaattcttttctcgtgccggcaacgaatatcatggtcttactctattagcggatgaactaatggaaatgactaaagaatctcgtgaaagacaccctaatggggttttaatcgacggtgaattagtttaccattcatttgatattaaaaaggctgtgagctcaggaaatgacctgtcgttcttatttggtgataatgaagaatccgaagaagtacaagttgcggaccgtagcacttcaaacggtttagcaaataaatctcttcaagggactatttctcctaaagaagctgaaggtatggttcttcaagcctgggactatgttcctttagatgaagtctattctgatggcaaaattaaaggtcagaaatacgatgttcgttttgctgctcttgaaaatatggctgaaggctttaaacgaattgagccaattgaaaatcagttagttcgtaatcttgacgaagctaaagtggtttataaaaaatatgttgaccaaggtcttgaaggtattatccttaaaaaccgtgattcatattgggaaaacaaacgttctaagaacctaattaaatttaaagaagttattgatatcgctttagaagttgtaggatactatgaacactctaaagaccctaacaaattaggtggtgtcgaactcgtatcacgttgtcgtcgtattacaaccgattgtggttcagggtttaaagatacaactcataaaacagttgatggtgtaaaggttcttattcctttagatgagcgacatgatttggaccgtgaacgattaatggccgaagctcgtgaaggtaaattgattggacgtattgctgattgtgaatgcaatggttgggttcattctaaaggacgtgaaggcactgtaggtattttcctcccaattattaaagggttccgttttgataaaacagaagcggattcgtttgaagacgtatttggaccgtggtcccagacaggtttataatgaaagcttatttagaaacagttattgtagctaagaaggatggtggagatgtttccacctcttgctctcagattatattagattttcctaataacgattcctatcatatttttatggacaatttcgataagtacgaaaaaggctataattttgaagtttatcgtactttgcttccgattgtggattaagagccttcgggctctttttggcataaatataaattattactaaaaggaaaacactatgtctgaacaattaaatgaagtgtttgaatctgaaggcagtcttcctgtcgtcaatttgaaccctaaagctaaagttccacaagtctggaaaattggtgatatcgatacaaacatcgtagttcgcttattctcttacctttctgaaggcgatgctgtaaaacaagttaaacttggcgacaaatacgctcatgttgttattatgagtctgtctgaaaagggtaatctcgctgaattgaaaaatggccttggtcctgctcctattgatgcaatcaacaccattttcaatactgtatatgaacaggttaaagctcttcgtatggatgcagttctgttccgattccctaccaagaaattgaaaggacgtggacaacagcttcaaactcttcttgctcgtttagtttctactaaaaccggtggtcgttttaaagtattgtcggcaatgtatcaattcacaggtaaacacacctatgtgatgatggttcgtaaaaatgccaacattgaagatattaaaggcatccctaacattaacacagagttgtacacgaaagtagattctgatgttggcgaagtttatgtgagtaaaaagactggcgaaacggttaccaaagaaactgctatcgctggttctattgccgcggtagaagaaaaacgtaaagataagcctgttattgctcgcaccaaaatttctcgtcgtgctattgcagcaagtcaatctttagaagctgaccgacaagaaggtgagttattccagaaatacgaaaattctgctaaagaagttagtggcccggctacagccgaattacttcctgaagcatatgaaatcgtactagcccaagcatcgtccacagcaaaaggcactttagttgctgatatcgaaaataagatttataatcgtattgatgaatcctttaaatttgccgatgaagtttcttatggtagtgttattaagccgactttagaaaagtttgctaagaaaattaaaaccgaaaaaacaacatctgttaaagcattagctgcttttgttgaagctgcaaatgaaattgcagactctattaaagacgaatggtttgaagattttagacgtgataatttccaactgcctgacgacgttttagctgaagtatctgaaagaacttggaaacaacgtaaatcagcgttcttgtctaatgtgatgtatacttatgcacgagaatcggctagaggcacctttaatataacaatgaatcgggaccctaaacaatactctgttgctgaaaaacgagctattcgtgaatatgcctcttctgcatatatagatatcaataatatgttgttaggtcgttataaaccagatttttacgatgttgcagatgaagatgaagttaaacgcgctattgatggtcttgattcggcgtttttaaatggagaccgtttacctgaaggactaacgttatatagagctcagtctatcagaatgcctatttacgaagcaatggttaaaaataaggtattctacttcagaaactatgtttccacttcactagctcctattattttcggtgggtttaaagagaacgttgcccttggacttgctcctgaagaagttcgcaaagagcttaacattgacaataatgacgaaggtgttactatttctcctagtcaagtaagaacagctatgcatgcaccagaacaaatccgtgttaacgttggatgggctattgacggcgcccataaagttaacgtgatttatccaggacagttgagtaatcaccctaatgagcaagaaattattttgcctagaggcattctcttgcagataaataaaattacagatgcgtcatctgacaccggtgcaggtttagaatccaaccttaaatttattcaagctgaagtcatgtcctcagaccagttagatgaagctatcatttacgatggtgatgttctcatggaaacaggcgaggtggttgctatgacgggtgaaatcgaatcagatgagccggtatcgttctcctcatttgtagaaaaaactagtgcacctaaaggtttgaaattgttagcatctttaatggatttagaatcagttccgtttaaatttgtccaaggatagtttacaaacacatggatgtgtgatactatcatcccatcaacaacatgaggaaaacgttatgaaatctatgcttcgctttaatggtcaagaactagtagttgaagatgttatcccggcagatgatgtttttaacgaagctgtgattgacgaattgaatcgagtattcccaggtgcattccatattgctatggaacctcttaaaaactttcgtgaccctgagcacactgatcaaatttttgtcggtgtagtgacaggtcatttagaaacagaggtaccaatggtcgtattagttaaatactctaaagatgatactccattccgagcaccagcattcctttcattccgtaaataaacccctaaagggagacaacgtctccctttttcttatagtcctaaaactcttgacgcagaattcaccacacctgtcaatgtgtttatattagacacaccaccagcagtcccacctaatctagaaagtcttgatactgcacttcctagtccagaatcattctgattatttccaaacattcctgaaacactactaataagtcctgattccagccattctaaagcagcctgtctatttacagcacctgattgcataacgcgataggcaaatgttacgtcaaaaactgttatctgattatcaccatcatacgttaactcaggagaagagacactaacaggaatacatccagtgaacatgacagcggtatgtggtaaaccatttcgtgcatgtaaattaacctgaatatctgcttcgacgtcttgtggtaaagcgcgaagacctgttacagggtcttggactgagtttacccagtcttgcattgctctaaagttagatgcttcggaatccattctaaagcttattactaacgggtccatttcacggccggtaattcggatgttcggggagttatagttgaaatccgtttcatacgataatcggttctcaggcatttttacagaataaatcattaaacctgtattattatatgccatattgaagaagtctatcagataagctcctactgtgaactcacctaacaagctttgtaccgtacgttgactcattgctccaatcagatatttacttatacctgattttcgaattaatttctgtgttcctgctgtaatcagggttgttacgccctgattgatatcaccttgagacaatcctagccaatctgaatccaaccctaagttattataagcaaaactaccaattgacgaaattagtgaagacgatttggttgatggtgtagtagcaaatacacaactaaacatattgtttcgttggaaatctgcatttatagcttggttattaaattcttctaaagagtacattagaaagtccccgcataaagtgaagaacggtttaatgtaataatttctcgcattgttatctctaacgtaaatgttgatggtaagttaggagcaacagcaagaccattaaattgtccatttggagttttatcaaaacgtacgctttgaatttggcatggaccaaatacgtcagttaatccatcaaatttagacgtataaccaaagtttttaaccatccaaattgtagggttgcttacaactaatacatttgttaatgacgcagtaatcttttcaaacaatgtcttattttttactgcatcatccggcgtcataggctcaataaacgttgaacggtaccattcgtctaaataacttttaatctcttgggcgtactgtgatttaccggtctcaccatatgagaaatagttaaaatactggtaaatgtttataatagccataaggtcttcagttgaacgtggagttaaatcccatgtaaagactttagtacggttctcagcaccaccatacatactacgagaagtcgtataaatctgttcgttattatcagccataagcccttgagtaatagaatctaatgcaccaaaaactgcagtagaagcaatgttacttaaaacacccgtagcagtacctccacctttagtaataaggctatcaccgatatcattaaaacgatgtgaagttgtatcaacatcagatttggaacgtggcaaaagtatattagcaacaggagttttgtttatagtagacttattagctccggcaggaagcaagccatttgagaatttagtcactgcatctttcacgttatcagttaaatctgatatgataccattagatgaagtaccggcatatgccggacgtaaattcctgagggatcctgaatcgcgtgcagacatattgtacgcggtaaataataatccattcttataaaggtctgttacctggaagtctcccgtggagtcatttccggctgctcttcctgtaggaaattgagcaacataagttttagtagttgtttcggttttagtgctttgcccagcactttctgagactgggattgctttatttaaatcctttgcatctactactatttcttttacactaatcataataatccttaattaacaccggtggcatggaaaattccaggagccgttgtacttgttacaggggtcatattctggactacggtattctttttgacgacattatttgtgttactaatcgccgttaccggttgctgttgtttagattcagaagcacgtcctttctctattgactgaacttgttttgcttccggagatttagacgaagattcaggcttaactgtggtctgagcttttttggcttcagccattttattatttagcttttcaaatctagcatctatttcctttttaacaacaggagttttattaagttcagggtctttaataagtttacttaaatcagcataagacttctcgacgtttttagcattttccggattagtcatatcgattttatcgatataatcctcaaatctaaccagtgccgcacgagtttcattagcttttatatacgcctctttacgctcctcttcaggtagctcttttaattttgccgattccgcagcacgctcatcgcttgtactaaactcttctttattgtcattaccacgaacccagttagtaacgaatgttttgccgcgttgtaacatatcaaaacctttagaaacggttcctaattccccatcgtcacgcttcatttgatatttagcgactttctcttggtcttctttctttaatttgttcccagtagtttcttggaatccttctaaagcacgtccttctatttcgtccgcggtatcaccaaaacctatagcacgcaatatagacgcagagagtttagccattcctaattgaattagttcacctaagttcattaatgctgttcctacacctttgacaatagcaacggttaaaccaccccagtctccagcttcccataattgttttatcgagtcaacagaagtgaatatatcgcttaagaatttaccccactctttagcttcatcggagaatttagtaaagttttcatcaaataaatcccaggcagaagtgaacttgtctgtccaatatttgaaatggactatcaataaatcaataccgataacaataccaagaataagtgcggccatttttgctgcttcaatagcagccgttatagtgtatttgaaaagcattccagcaattctgtctgaaattgatattgatttattaaacccggtttgaactgttttggtgagcattgcaattttatcgctcaatttaaagctaattccgcctttagaatcagaagtagaattagcactttcttgaaccggagccgggaagaaatcttcgtccggcttattatcaatcttttcaggtgtagggaatgctttaaacagctcatcagaagtttcattctcaacaactttaacaggtattgcgttctcaattacttcaagagaggtgcctcctgtattttgaatagcggtagatgtttgtaatttttgctctaataatgtagctaatcggtctaacttagagcttattgcactagaaacttcgtttatacttttagtgacttcagtttgtttttcaataacttctgcgataagctctgtgccttcagcagtattatctgtcgaattctttaagtctccaattgattcaataattccattgcctttatcttctacactttgtgatgtgagttcagacgcggcttggacatcgtctagttttgatgaaatgtcattcaatgcttctaatgaatcggtagctgctgttgcagctactttttgtggtttattatcggcaatgaccttatttctacgcatggatttcatttcttcaggtttcattcaagcaatccaataatttctgctatacccttaataggaccattagggcctggaatagcaatagttgtcgaaaggtcttctgcccatttgattacaaaagcaggcatctcaaggaaagaaatttctttctcttcgtcattaacttttattaagcaatttgatagcatttcactgattgtagcgaattgttcaaatttgcctggtggtctaaaataaaaagtattaccttgaaattggaattctgttcgttggcatacatagacgtcatctagtttataagtgaatccatctttttcaacttcagacttaagtttgttattaaattccaatatgtgtagacatgcaaaatcaaaatctgcgggactcatatttttacaaatagaatcagctaagattttcatgttttcatcagggcctttaacgtcctttaaaagattataatgtttgagccctaatttaggaatcattacctttttattagactgtggtagaattattttctttagaggtagaatcagatttaagttcatttttaaccttaactgggttaacaggttctaacaccattgagttggtaaacatgtacagatgagtttgtgagttgttatttgataactcatgaataacttcatctacgtaaaattcggatttgaattggttcttttggtcaacaaatataattttagtagcaggcgttatgttaaaattgcctgtagtagtgcatttagcatatccgtcatattgagccattgtctgaagacgacttgcttcttcaaatccattacgataggtcatttcggaatatccaccggatcttgacacaagaatagcattatcaccatcgcctgtaacaataaccggaatagatgtatctaaaaatgaatgagcgaatatcgtggcgtttttaatagggtctcttgtaaattggttggctttagtcatccaggtaaaatcccatactaatggatactcaagctcttgaatatactgacctacagtatttggctcacctacaatcatcttaatgccttcctgaccaataagagtatcgtagtcaatcatgtttacgcctaaaatatcttgccatacgaatacgaacttatcactcgctgtagcaagtcctaattctctgacatatgccaaataatcatcaaatgtgcttgtccaagggatatcaggaacataagcattaatagtgtttattggcggagtaattaacgcacggtctttgtatatgacacctaacatttcacgtatagattcgcctgcgtccgggaagaatggtcggccaaatttaaggttctctatagaatgtattgttccaagctcaattgcaataatattgtcaccttttgagtccacggacacagaataatgtctacatccataaattcgagttctaacttggagaggtgtgtttgaatttgaaacagagatttgaactatctgtctaccgtccattttagtgtggatgtttttagtgtcataaaattgaagaatcccttcatttcttccatataacgaatctcgcatggttaaagttgttattgttgccgcgagttcaacgtatctattttcttgccaagccgaataatcttggtataatttaacgcttaagttaggatatcctggacgttggaatactgtcattttttatggtccttttctactaatgttaaagcaataccacgttcaacaggaatcatttgcataatagaatccaatgtgtattgactctttactagtgaatggtttatctgatagaatgtaaaaatctcatcagggttaactaacaatttaaaaacctctaagatatcagtatatgttttaacatgacgttcacaacaacctaatctaagggtcaaattaatagggttcatagaagcaataaccttctcgagcgagtcaatgtctattgcttctattacttggatttggttctcttcagtcaaatcattccatggataccattcatcattataatatatttcttttatgttttcacttatcattaatgctttgttgtcataaaacttttcagggaaagaaaaacgtatttttataccagcaacatcaagttcaggttcgactagttctttttgatatatctcaaacggtgcagttttttctttagagcatttagggcaagtgaaaataacgggaacttttgttttgcctatagagcctgcaaaaacttgcaggaatataaatggttgccatgttttagggtactcgccaaaataatcatcaatcagatcggcaattatttctttttgttcttgtggcgaacgatgttcgatatcatttctaactagtaaaaagtctctataatccgccacggtgaacggcttaaaacgatgaacaccatccggtaatttacaacgaattatattagccataattactccttttctattatttataaatacacaataaaggagttaacatgtacaaatatacgtttaccgtacgtttaggcgataaagaagtgaattgtagagcctttactttaaaagaatatttaggactcataggtgcgcgggctaccggtactattgaatcagcagtgaacaatattatcactaattgctctaatgctaaaaacttgactaaacaagaagccgagctattgttggtaaatctgtgggcacattcgttaggtgaagtgaatcaagaacacacctggaattgttcctgtgggcattcatttcaagtctatatgaatttattacacactcaattagatgaacaggccgatccctggtattcgtttagtggtattaaaattaagttccgtcaacctaaattatttgacgataaaaatatcgcattaatgattgcttcatgtattgaggccgtttttgtcaatggagagtccatccctgttgaagatttaactgaagcagaaataaacgacctttacggccttataacagaagatgacatgatcaatattaaaaatcttttggtgtcgccatcaatttatctggcaacccctattaaatgtcccaaatgtggggcgtcacacgttcacacaatacgaggcctcaaagaattctttgagttactataatgtctaatatcaataaactttattcagatatcgacccagaaatgcgtatggattggaacaaggacgttgctcgttctgtaggacttcgttctattaaaaatagtcttcttggcatagtgacaactagaaaaggctcacgccccttcgaccctgaatttggatgcgatttggtcgacgaacttttcgagaacatgacaccacttacagccgatacgattgagcgtaatatccaggcagctgttcgtaactatgagccacgcatcgacaaactttctgtaagtgtaacgccagtatatgatgactatactgttatagtagagattagattttcggtcgtagacaaccctgacgatattgaacaaattaaacttcagttagcgtcaagcaatagagtgtaatgcttcaaggaaacctatgtataatggttttaggtccttccgatacagccgggagattattagttaaaagagagaatattatgaagctggaagatttacaggaagagttagacgcagacttagctattgatacgacaaagttgcaatatgagacagcgaataatgttaagttatacagcaaatggctacgtaagcactcatttattcgtaaagaaatgttgcgtatagagactcagaagaaaactgctctaaaagcaagattagactactactcgggacgaggtgacggtgatgaattcagtatggaccgatacgagaaatctgaaatgaaaactgtcctggctgcagataaagatgtgcttaaaatagagactactttacaatactggggaattttacttgagttctgtagtggtgcacttgacgcagttaagtctcgtagttttgcacttaaacatatccaggatatgcgagaatttgaagcggggcaataatgcgttattcaattgaagatgcctttaataatgacgaagaatttgaaactgaaattaaattcttaatggaaaagtatcgtctacgtcgtcaggatattcgtatcctggcaaaccacccttgtggcgaagacgtcctttatattaaagggaagtttgctgggtacatcgacgagtatttttatacaaaagatatgggtatcgatatgtgcatgcgagtggtataaatagatatgtaatttcaacttaggaggcaatcatgtcagataagatttgtgttgtctgtaaaactccaatcgattctgcattggttgttgaaacagacaaaggtccagcacatcctggaccttgttataactatgtccaacaattgccggtttcagaaagttcagaagagcaattgaacgaaacccaacttttactatagtgttaccttttttgcctatggtttttggcccttccaaaaaggtcgggcctttttttaattagaagtcttcttccacatcctcatcatcgccttcaagttcggcacgcttacctgctaaggcatccctgacagaaatatcatctgtatcttttaattccgtttcttttatacgtttcttataataagcttccaattcttcaagcccttctagggtatgacaactagcaattttacccatgaattcgtcaatagatgcttcgtataaaaattgtttaaattcaagtaccatttttatctcctaagggccgaagcccttataaattaattgttttcattacatagttaaatttctcatcagcgtaacgttggatacgatcaataccgtgttttaacaagtaattaagatgagtatacttctttttagtatttaatgatttaggttttacacctgcatcgtcgatgagatcccaaactgtagcaacagatttagaaccatgcttacgaagcacgcgacctacggtttgaagtacgataatttttgatttaacaccatgggcaaaaataacatgatgaagattcttgactgaaataccagtagagaatactccatatgatgcgacaataataatgcctttaccattttctgccatgactttaagcgcgttacgtgtttcagtatcaacttcacctgatacgtaataaactttttcgtatccaagctctttaatagcttcaaatatttctttaccgtgtgtaacgtgtttaaacattacaaaggcgttctcgtctttcttagccaatttgactgaaagttgagcaatccactttgtacgtcgttttagcccggtaataattttaacttcttcttggtatgttttaccttttaatttaatggtgaattcgtctggataacgaaggaaaatactattaatcttaagctcagttacctgtccatcttccattaatttagacgtgctaacaggacggaagatttcgccgaacatacctacgtactgcattacattggcctttccgtctcttaatgagccagataaaccgaatttaaacatacaattatttaatcctgcgatgattgaagaaatacttttgcctgttgctaagtggcattcatcgttcatcatcataccgaactgagagaaccattctttaggctgcttaactactgtttgccatgtgccaacaataattggagcgtcgtttttagatttgtctgctttatcagcaccaccgccaattttcttaatcatcgaatgactaaacaagcgataatcaacaaaatcattagccatctgggttgtcaatgctgttgtagggacgataatgagaattttaccttcatagttctctagataatatcgagctaaaagtgcttggattagtgatttacctgctgatgtcggaaggtttaaaattcgacgacgattaactagtccttcatatactgcatctttttgataccaatgtggttcgattttgacgttgcccgaataaatttcttgtttagaaagccatgcgtcaaaatcttctctggtaaggtcttcggtctcaaagattttagggtcaacccatacagaataactcatattgctacagaacttttttatttgtcctacaagtccatatggtaacaaacggttgtaatctaaaagacgaattctaccatcccattgcccatagcgatattttgggttaaatttatacccgtcagcttcaaagctaaaaaagtcacgaagttcgtaaaacgtactttcgtcgcattcaatgcgcacgtgactaaaatcataaaaatgtactttaatgtcagtcatgtcaaattaccatgtaataaatatagttatatttataatgaggaaataccatgatcgataaagactatattgaagagttacgtgctctttctgataaaaaggaagccaaagctaaactgtttgaatatgcgaaacaatttggcattagtgttaagaaaacaaaatcattcgataatattgttattgatatcgaagaagctcttaacgcactggctgatgaaccattacctgaaaccgatggattatctatcaccgatttaattactgccgcagatgatgtggacggtgttaatttcaccaacgaagaagttaaagaagaagctattctgttgtttgattctccaacagaacaagttgaagtattagaagttgtcgaacaagaaaaagaattcgaccatgataaattcgaagaagcaattactcaggttgttgaatccgaaaaagggcctgagtcagaggtaaataaagaagtaaaatttgttctgcctgaaaattttagtcctacactcattaaattaggcaaaggcccaggatatgttactgttccttggtggatttatcaatggatagccgaaaccccagattggaaatctcgcccaaccagttttgtgcacgcttctgctcaccaaacattatttagcttaatttattatattaatcgcgatggatcagttctaattcgtgaaactcgtaattcttctttcgtaacattaaaataaggataacttatggcttttacagttgatataactcctaaaacacctactggagttatagatgagactaagcagtttactgctgcacccagcggtcaaactgaaggtggaactattacctatgcatggagtgtagacgatgctccccaagaaggatcagcagaaacttttgattatgtgttaaaaggacctgccggaacaaaaacaattaaagttgttgcaacaaatactattcctgatactgacgctgaaacagcagaagctactacaactatcacagttcaaaataagacacagacgactaccttagccgtaactcctgctagtccttcagctggagtaattggaaccccagttcaatttactgctgccttagcttctcaaccagctggagcgtctgctacgtatcagtggtatgtagatgattcacaggttggtggagaaactaactctacatttagctatactccaactgcaagtggagtaaaaagaattaaatgtgtagcccaagtaaccgcgacagattatgatgcaaaggaagttacttcgaatgaagtatcattaacagttaataagaagacaatgaatccacaggttacattgactcctccttctattaacgttcagcaagatgcttcggctacatttacggctaatgttacggatgctccagaagaagcgcaaattgcgtattcatggaagaaagattcttctcctgtagaagggtcaactaatgtatataccgttgatacctcgtctattggaagtcaaactattgaagttactgcaactattactgcaactgattacgatagcaaaactattacagcagaaggtcaagttcaggtaactgataaagttgctccggaaccagaaggtgaattaccttatgttcatcctcttccacatcgtacttcagcttacatctggtgcggttggtgggttatggatgaaatacaaaaaatgactgaagaaggtaaagattggaaaactgaagatccagatagtaaatactacctgcatcgttacactcttcagaagatgatgaaagactatccggaagttgatgttcaagaatcacgtaatggatacatcatccataaaactgctttggaaactggtatcatctatacatatccataatagtaaggggcttcggcccctttcttcgtttttaaagcatacaaaacacaacttgagattgatgtatataatggcacaaaccaaatagtacgggattgattatgagaactgaagttgaagtttatacattacatgaggcgggattttcattcgtagaaattgctcaaaaaattggtttacaacctaaagaagttggattactatggactaaagccgagacagctcggtcaaagtttaaagcaaaagaaaaagttgtataccgtaaacgtttgattaacaaaaaggtgaagaaatgagttttgcacaggaattaagagaaagggcactggccactaaagctaatttgttgagtgattttattactaacttctctgtgatggcagagaaagccgctgacaaaggccagacacaattcacgtactacccgtcaaagaacgatttaactataactgaacaagtcggtcaatggcttcgtgataacggctttcagtacaaaattaatcacgaccagcgtgatggtcattggatagaaatcaagttctaatatgctttacattttttgatggtataatgaatctaggttctatccattcaaattaaacatccggtcagagatagagtctctgctaattattttgatattattatttataatggtgatttatgtttaagaaatacagcagtcttgaaaaccactacaactctaagtttattgaaaaactctacactaatggtttgactactggtgtttgggtagcacgtgagaaaatccatgggactaacttctcgttaataattgaacgtgacaacgtcacatgcgccaagcgcacaggccctattcttccagcagaagatttttatggttatgaaattgtactcaagaagtatgataaggctattaaaaacgttcaagaagtaatgggtagttctcgagctgtatcatatcaggtctttggtgaattcgctggtggtggaatccagaaaggtgttgactacggtgaaaaagatttttatgtgttcgatatccttatcaatacagaaagtggtgataatacgtatttgaccgattacgaaatgcaagatttctgtaatgaattcggttttaaaatggcaccaatgcttggacgtggcacatttgatgctcttatcatgattccaaacgaccttgattctgtcttagccgcttataatgctactgcgtcagaagaccttgtagaagcaaataattgtgtatttgatgctaatgttattggcgataatacagcagaaggttatgttctgaagccttgttttcctaaatggctgccaaacggtactcgtgtagctattaagtgcaagaactctaaattcagtgaaaagaaaaagtctgataagcctattaaaactcaggttccattaaccgaaattgacaaaaacttgcttgatgttctagcttgttatgttacattaaatcgtgttaataatgttatttctaagattgggactgtaacgccaaaagattttggcaaagtgatgggattgactgttcaagatattctggaagaaacttctcgtgaaggtattgtattaacatcatctgataatccgaatcttgttaagaaagaattagtccgaatggtgcaagatgttctgcgtcctgcatggattgaattagtatcataacgaaaaaagggaccttacggtcccttttttttttattcatcaatgataatttttggtagcttaacacctaataaaacagacaagtctgaacgtcctgccattttatccatgtccccaccatcaattattctcgcttctttttcatcttttgctactgtgtaaggatttgctgataaagcatatctaaccaataatccgatagacggttgcaaactttccggatcaactacaactttaaatgcaccgacatgttccgggtcatctaaatctactccttcagtgtatggagcataaaagatggaccctacaatttctttttcgccgatattttctacaacacccacaataacataatctaacggactgttggtatcgcagtaaagaggtaatccatttgccaagaatccataagcattttgtgaaagatacttgtcatcttctggcttatgttttaaccaaccagaagcagcaagaatagcagctgcacgagctgaggctacacaaaacgttgcagtataagttgtctctttttgaatgtgtgataccatttcacacaccattcgatataatgaacgacctgcttctggagcggatgcatagctcaagtcaataaatccggtgtcagtaattccagtaactttataacgtttcgatacagtaattaaagactgaagaatatctttattaatttcatcagccatttcagtagcaagcaaatcttctaagaagttaggggcatcaaatccattcgcttccaaatcttgcgctaattcaaccgtgaggccagttttaagtttacgagatttgactgaagtttgccatttattaatctggaatcttgcatcagaaatttcgctatcagagctttcaaatttgcttgttaccgctgcatctgaaaataaccgtacctttaaatgaacgactgcaatctgaagagctaattctagatcactttcttgaatatctgcaaatggtgtatcttctaacactttatagacgatattattatatttgaaaaaatcacctttatttagtgtgacttttgattcttctgtgagttcagtaattttttctcggtctacatatccaacttcgccagcataagtagcaccagttttaaatgtaaattcattatctgggttaagatatttgataccataaaaagcagcaacaggttgattagttctttgtgttgctacaatgtcagaatatactaatttagtcgtagcgcgagtcaaagcaacgagatttgggcgaccaattgagttgctagtagacgttgtagattcacgcaataatttttggattttactcattgcattttttccttatgtgatatagattatttataaagattgtttacaacgtatttggtatgtgatactatagacttatcaactacagaggagtaaacaaaatgactaaagcacgtttcttacgagatactttaaaagttctggaagctgaagcagttaagttagtagaaaaatatggtgcaaaagttaatggtaatgccttcaacaaagtatggatgaaagttgattctgaagctcgagctaaaggttattgggccactgataaacttgcatcattcaaaaacaaagatggttctccggcatatgtccaagaaggtatgcctaattggcaaaatattttgaaaacttacatcgaaattgcacagaaataaaaccaaaaatgggagaccgaagtctcccaaaataagatttaatcaattaagattagatgccttttacatatacacggcggaagtaagcgttcttaccaaggctgttcaggatagatggcataccggactggatgcgagcacctggagcctgcagggaactttcagcaaacgggttaacaccgataccgtaacgagttttaaagcccattaccggctggaagttcttaggatcggaaccacgcagcggggtaagtgcaacgtaaggagcatagtaaatacctgcatccatttcgttagcgcctttgtaaccaacggtgaagtaatcctgtttagcatactggtcgatgtatacgcggtatttaccaccaagtacaccggcaaatacagacttagtagtgtcggtattaaaaccagaagccagaccctgtgcagcgtaagaaataccagtatcaactgaagccagtacgttaactacgttacgggaagcgataatgaagttaccttcaccgcgaccggtttgacgagcaatttcaactgcttctttatcaatctggaacaacagagatttaaagctttcaccggcccaacgagcaccacggatatcaatcgggtcctggaagtcaaatacaccagctttagaacccggagtcagggtcataccagatttaccaacctgtgcagagtagttaatccaatcaacaacttcacggttgatttctagcataatttctgtagccagaataccgctcaattcagcatcagcatccataccgtgtactgcacggaggtcttgtgctaattcgatagagtaagcagctttcagctggcgagatttagcttcgataacttgtttatcgatacggaagcccatttcattccatgggttatcggtagaaccgttgaaaccttcctggagttcagcgatagaagtagccataccttcagcgatttctaccagtgcaccagcttccatttgtttcttaacttctgcatctaatttagctgcatcagttgcaccagaatcaagtgttacgacagcagaagcttgcagatatacagtaccagtttcttggaagaagtgagtatagatatcacctacaacagtagtagtgtcagcagccagagctgggaatttcttagcagcaccctgaccagagaacatcgcatctggagcatacatcggatggaaagcttctttagcgccagcagcgatagggtctttaccatatactgcacggagagcaaatacctgaccggtcgggctgttcataggctgaacaccacaaatatcaaaagcgatcagattaggaatagcacgacgaaccatacccataactgccggcccaatttgggttactgcaccagaggtttgacccgctgcgatgttctgagcattataaccatggtcaccaccaatttcagcttcggtcaagaaagaaccaaatgcctgagcgattttctcgtctttatattcaggggatacttcgaaatctttttcctggttttcgaagattttagcgataatagcctgcttgctattagcgatttccggcaggccttcaccttccagcagttctttccatttgtctacgagctgagctttagttttgatagtagtcatttgtgttaacctttaaattagaaacgagatgcgactttcgcatataaacttacattagaattctgttctacctgagttgtggtagtgtcaactgcttcggcaacaaaattaagaccggcagcgtcattgtcaactgtatttatactttcggtaatagcggcttcttctttagtagaacctttaaccatttctacaatagcagttaacttagtaccaaatgcgtcagaataatccataccttcaaccaggccaataactttttctttctgagattcagtcaggtcttttacgctttcattaatagcggtttcacgctgaacgtaattgatatatgcatcacgtttggtaacttcttcgaacaaacgagcggtttcttctttatgttcggccagctcttcttccatttctgctacaacatctacagattcttctggaacaacaacgttatgttcaacaaacagttctttcagaccaccaagcatggattcgaacaaatcagctttaatgcctttatcaactgcgatttggttttctgcgagccattcttttgcaagatggtctaggaatttagaagcttgttcagccaattttttatcagctttctcttcagcatcttctttagccttttcaacttcttcttcggccttttcggcgatggctttgatatgagattcagccagtttgactgcttcctgcttaacggtggcttcgaatacagtgctgaaattagctttaacgtccggagacagttctactgattcgaaaacactattaagagcaactgaagtctcgatgttctgagcttctttcaaaagttgttctttgatcattttagtgtcctgtggtttagattacattattatttataatgcttttaaactctctgcgagagctttaaatgcttcgtcagcactgtttttggtgatttccaccgaattttctgattctgatatttgtttaggagtaacccaagcatctggagcagaaggtccccatacggcatctacgccgacggttaatttaaatccttcgttcacgatacggtaccctttattggtgtcggttaaagaaccaagaccacgagaggaaacacctggaatccaaccagctcgtatattagcagctaatttatcaccgggaccatggtcgccttcaataattctagcacgtccatatacatcgtttcctttccaccacatatcttcaataatgatagcggcttgcatagggtcaacatttgcacgaggtggatggtttaattctccaagggcttgtttggttgcgacttgttctttaatatagtcacttactgctttttccaaaacgcgtttaggatataaacgtttatttcggttaacaacctctgcctgaagaaaaataccttctatataaagccctggttttaagccagaatcttttccatcatgagattccaacattggaacgccatcaataatctcaccgggttgaccccaagtttcaataagtaactcgggtttattcattagcttaatcctaatgctttacgacgtttaagagcctttttacgcttacgcaagcctttaacttggcctgaagggttagcttttttagctttaacgaccttacgagcgatttgtctacgttttgctttagaaagaccagtggtttggaacgcgttacgttcacgagttttacggtctttagtgcgggtgacttcaccacgagaagaaacatgtttaacgataaactcatttaactgttcttcattaataatggaagccattgcaacagctaaatccgtttcagtttcaagcatgttctcgataatagtatttatatcgtcaatatcgagagcagaagacaatgcatcgattcggccctgtgcttcaggaataagtgcttcgacattttcgagtaccaattcataagattcagggataagatacattattcatcgtcctcatcatcttcgtcttcgtcgtcatcgccttcatcagcgtcgtcttccgaagctttcttttcttcttcttcttcaggttcttcgccttcaatcaaaaattgagacgcgatttctgctttgcgtgcttcaatcaaacgaaccgttttttctgccattgcactttcaaaaaactttcgagtagcaacgaggtcgtttgatttaatagcttgaattaaatcgtccattaaaaatcctcttgttcttggtcggggtcttggaaacgagcctctttcgactcttcttcaatttgcttagcctcttgttcaatttcctcgtcagacatctgaagaatatctttcatagctgttctgtgagaaatatatttaccaataaatggttcggccatctgaagcatattaatgcgacgctccagaatctcagcatcctttaattccgagaaataactatcccgatgaaattttatcttaatattatttatttcatcattccactcatcttctgtaataattcctttaagaattaaattagttttaagcgggtctaggaatatctcttcaaatttatgttgcagctcacgaataaatttaccaaatgataattcatctcgtgtaatagaagtaccagcatcaaactgtataccaccttggtcacttggaatacgggtaataggaatacgtaaagccatataaagcgcattacggaaccaacgtacatcttccatatttccggtattatctgcacctggtaatgtatcaacttctgttactgctttaccatcacgtcgttgtaaccaataatcttcggtcatcgacataatatgctgctggtttttaatcttgcctgtagtagcatcatatgcaatacggtttttcatcgtattcataacatgttgcatatgttctgctgcttttcttgaaggcatattacctgtatcaacgtaccatacacgacgatcaggagcacgagtaatacgataaattacgacggcatcttcaagaagttttaattggttcgccggcttaatagcccgatgcaaataaccaatgatatttttaccacaacaatcaactaaaccagaatgggcataaacaatcgcggctttagggatttttatttttgtgccagcttcatatatgcgaccatcacaagcgtaagattcatgtgatgtgtcataaatgaaatattctttataacccttgactattttaacaccggcttcagtggttgtaataacttcacggacatattgaacttgacgtggatctaaacgacgaagctctttaataccttctttagggcgtttagggtcaataattttatggaagaaaattcgagaatctacataccaacgtctaaaatgatctgaacctttacgttggaaagataaatgatttaacacttcgttaaattcatccaacatcattgatttgatatttggactaaattttgtgttgtctaaatttatagaaacgacttctgtatcatcttcatacacgatagcatcggaaactatttcagagactgcattatccacttcatagttcgtcatcaaatttcgatacgtatcgattaattcacgggttgatttgagccctggttcttgactaccgaacattctctgaaacatagcattatatgtttgctgtgcttcattttcagatacttcgtattctttagcgccgtcgtctaattttggtgcggtgatagattctaaattttctttttcttggtctttgtaatcacgttcgtccatttttgcccatggagcaaacaaacttaagatattaaatttcattgtattctccgaatgggaattatagttatatttatatggacttctccgtcatcacgggaagctggggatttctccccaaccagattattcccaccaatcaagagcaagagttacttcgaacgtttcaatctcgttattgctgtcccagtcaagagatacttcgccaacgttagtaggccacaagccgacaatttcaacttctttagtgaccgttttagcatcacgggcaaattgacgaacgatagcagactttttatattcagcaggtttaccaccggtaatttcattaccttgtcctgctgcaataccttgccaatcaacaaatttctgacgaatgctatgagcatcatcgttcattactgtaatagtccaatcatcgaatgtacgatcaccggccacgttaattttacggttcatataagaaacaggaaccttttcaacaatcgcagcaggaagagccgtagcacgacactggaagctaaagttttgcccaagataagagatttctacttcgaacaggttagggcgagcgaaatcacctgattcgaaggcacgagttacgtcatctacaaacatattagcctctgtagtaatatgggcttaggattaacctgatgcccatagaattaatttttaaacgatatagtatatttatatgggctaccgaaatagcccatcaggcgtcttattagccacctacagcaccaattagttcgtcgaaatcggcaccagttgctgttgctacaaagttcaacgtaatataatttatcgagcgggcaggttgtaagtagaaagtagctacaaattcattacggtcgataactgctggagtgttattggtagtatcacaaacaactttaaagttatatacaccaccaagagctttaataccctgtagatattgagaagtctctgtacggaaagaagaacgggtaaatgcgttgttcaattcaaacaggcgatatttagatgctgaaccaatattcgttttaaccatattgaacaaacgacgaacgttaatacggtcaaatggcgaaggaacagaagtggcagttttatcaccgtacagaacatacccatcaccaccagtaccagtaacagggttaatagcttcctgatacaaacgatcacgctgcgcttggcgagtttcaattgcaagcttaataacgttaagaatttgtccacggttataaccggctggagacatccaaggctgagaaatattgtctgtacgagcacaaagaccagcgatatcagcagctaatggaacccaacgattcacgtcattatatttgtcatattgatatttatagttaccgtcaatagcggcataagtagaacttacattaaagttattatcagtgtaagttcctgacgcagtacgccaatcaaccagattatcaactgcacgattaacaggaataccgactatagttgcacgtggcggtgagcaaagaaccaagcaatcttggcgagaatcaccaattgctacaacatgtttctgaactgtagaagcaacttctaaagattcacctgcacaagaaccggcaataaacaactgcgcattaacagattcgcggtcagcaaacaaatcccaagcttccattaaatcaccagcgtcaaccgtttcattagatgataagccgccacccagtttgattacgccagagaaaccttttggccaaccttgtgcagtagcgaaaatataattgcttgcgcctttagcaaagaaatcatcaataaagatattactaccataaatatcgcgttcaccacgtttagtagaaagaaccacactctggactacagcatcgttacgacgaacgataattgcatattggtcatcagtttgtgggccgtacccaaagattgctttagcagtagatgcacgagtaccaccatcaggataaatttttaactgggctgaagcacctttgtcgtagtctgctttagatacgatttcaatttcgagctggtcgccaagttcaccaggataaagagcaactacgcctgggacaccatattttttaatagattcttggaaagttagagaagtaatagcttcttcagaagtttcaacttcagttaacagaatacccgaatcggttacgatagaaccaattgtaataacgccggaaagtccagaagaagaactggcaacttcggcggtccagttagaacccaatgccggatattcattaatttcttttgcacgagcaataattttaccggttgggatataaatgttaagaattttaccatcgacatcaaccgaagtgacataaccatctgcttcaacagtttcggtcaaatacttaacgataattttatcaccaactgcatagttactaccagcagcagagattgtgaattcaatattgcctgctacaggagatgagttcttagcagtatcacggtcaactgcgcgtacaacacgaaggtcattaccatattgaaggaagttcatagcagacatgaaataatctgctgtatccgtattaggagtaccaaacatatcaactaatgcaacttcatcagtgatttgtttaatctggaatgcaggtccccattggaattttccagccagggcagcagtaccagtggagttattaactacagtactctgtacggtagtttctttgagctcaacgcccggagagagaagtgacattttaattcctcttaatttgctttattttatttataccattgacaggccatgtgctgatggattatattcggctgaattacttgcacagtcaacaaatataaccggggcgtagtcgtcattcatatcctgtaattctcttgagaatacttctgatgcaagacgcatatcatctttatccgcatagtctgcaaatttctgttgagttgtcaaccatccgaaaataacaaggcccatcactaagtcgtcatggtaaccttcttcagcagcccaagatacacccttttcactaaacgttctgaattcttgaatagtagccctatggtttattttgagcttgtctttttcaataaggtcctttaatgtagagcaacctacaggcttagttctacggctttgcttcatgcctaaatcattcattgaatcacaaataacgttttcgtattcaaggtccatataaagtgatttagcgacagaaacacccgttgagttcaattcaatataaattggacattcgttatattccattagatatttaaacacaatatcagggagtataaggtgtgaaatagtattagagtgtagaacaccaacttgttcccatttatctgtcgtaacatcaataatatgcattgcgtgatagtcctgcccacgaccttcagaacagtctaacgtcgcaatatatttatgtccttcctcaggctttttgaaccgatgaaatccatgactatcaggtgtaacttcaatgtaatctaatatagccaatttcataccggaaataagtgtgcctgacgtcccctcgaaagctgcagtatgttcttgacgaaactgtgataatgaagaggctgaaatagtctgtttagaccactgccatccatcatcaaaaatatcttcatcgttgtatagtcgttctttaactgagttccaaattgcagtataaggttcaaatcctgatttaccttcaacagctgcagtccaaatatcataaaagtgatttaatccatttggtgtggttgtaataataatttttgaacgacgacctgaagaaataacaggttgaatagcaagccatgaatcaatgaagtttgggataaacgcgcactcatcaatataaatcatagcgaacgagttaccacgaaccgcatccggtgatgaagcgtaagcaccgattgaggaaccgttgtctaactgaatagaccctttgttccattcaacaatacctggttgtaaaaaatcagggagtaattcaattgcttgttttgtacggtctaatacttcagccgacattgagcctttatgtgcaagaatacctactgctttatctttgttaaagcaaacaaaatgagcaagaaaaatagctactacagtcgttttgcctagctggcgtgacaagttacaaacagtcatacgcttagaagacattattttaagcatatcacgttgatagtcacgaagttgtactttaattgtaccgtagtcgatatgggtaatagcacaatatgtctcagcaaaatatacaatgtcatcgcggcattttttccactcagcgaccatttcatatgtccattgagtttttatatttgctcttttaaggtttggtaaacccatataccgtgtacgtttattattcttatctttatatgtttgaaataattcaggcttatctgagttattaggaattttaactattttgtttatacgtagataatcactaaatttttctgggtaccatttaccatcccattgggatttaatccaatggataccatcttcttctttacgttcagctaaatgaggtggtagaataacaactttgtcaccttcatttaacgggtgattatcattcaatgcgttaattggctgttccattaatcaccttctcacgagcttcttgagcctcgtaagcatctcctacttcttccattaattctgttggagagcccatgaacactgtagcattttggatattcatctgactagatggagcagtacttttagtgccaacctgttcagatgtgatttctttcatatctttatgaagcttcagtatttctttgttcgtcgtagtcatttgccccataagagttgcaaatacttccatgtgacgaggagaatcggcatttttagccgtctcaagaaaaatcttggcagcgtccattaacatttgttgttggaagtgcatattcttacgaacaacgctatagtcatcttccaaatccggggtgcggttttgaggattactctgaacttccaccaattgtaaaggagcatatacctctacttcctccccagatattccagggaggtcagagatatctaaaagcttattaatatctagaccttccatatttacctcttattgttttctaggaccaggaggggttggtggagtcgggattggaatatcatgagtataagtttgttcaacttcgccattccaatcttgtgcttcaacgtctctcggtttaatttctgtatcaactgattcaaaaacactggcggctgtttgaaggtctcgttcattagcatgaaaatcaagataagtcgttttaataaggccttcagctgcgcctaccggaggatacatccatccatttacttcaaatgttaatgaccactctaaacgtcgacgagataaattatcgccgtctatttgttcatccattgctgctgccatccatacgactttaatatccctttcaaatggaatatcctgcccatattgctcaatcatagtcgtattaaaatgcggctgaaaatatggaataatttgctcaacgatttggaacatatcatcttcataacgagtaaagatgctcagttcaaaaatcattttaattggtgatgggttgtattggtctacaatatccttagtcgatttactcaaaagagagttattcaatatattcgttttaaacgttgggttataaacgaaatccaccatttggagatttatacgtggtagaatagtttcgactttagccacatcttcttgtgagtttatagaggtccatttattaagtttcatcataaagtgctctttagatgcatacgtaataggaactctaattaatttattgcctgtagacaattgacggttaacttggatatttgaaaacaaatcgcccatcattgtgatatatcgcctgaacgacgagttgtaaaaataaccaaacatcatttctcctaaccggcctttcgaccggtgtttgctttatcttatctatttattaattcataaacccatcgtcaaatggtgaattttgtctaccacggttgttaactactacatacggctcaacgtattcacttgcctctgaattgatttgctcaacttcagaatattcatcgatattaatgtcatggataccgtcaagatttctaacagggttaagttccaagtcactaaattcaggtatattgataccttcatttttctgaagcaccggattgatttcttcgccagagtaaataaacttgcctgcagtaattttacgaatcgcatttttacctacttgatagaatgggtcatatggttcaacccagttaatctcaaacaaactgttgtccattgggaagtatattaaatcaccttccttaggctcctgattgttgacctggtgtttgaaaagacccgggttaatagataatgtaacctcgtcttgaacttgcattccgaagttgctgaagaacgatttcgctccttcataaccttcaaaagagttcagatatgcagcaaatttccatgctttagtaaatttatttttaaggtcctcaccaaagataaggtccacagcaacatattcacgtggaacataaaaacattcaataccgcgcatctgtatgctttctgccactagaacatcggctaatgtctgactattctcataattattaaaattgacaaatggattgaggatttcagtctcatttgtctgagaatacccaccacgattttctagcttggcgaaaagatttttatcataagttgccatattaacctaccaaaatacctgcaggagggtccagtaaatataactcttctcgtaaagcttctttctctaaacgagcttcttcaattaatcgaacaccatcaacagtgacgccaccaggtaacatcataccttgatgtttagcaagaatttgtccattaagctctttagctaatgcagttgcataatctttaacccagcggttgttatatgcgccttgtttagttgcaggatcttcaccaactcgacgtcctaccaaattatggtctggattatcataacgttcagaaatagaccatgaatcacgaggaccaacctgaccgtaccctactgtatttcctaccatcttatgggtctcgatataagagcgaacatacgattcaacgataatgacatctttctgtctaaagttacccattacttttaattgctcgtttgcagagttaaaccaaaaatctggaagaggagcaatcatatcttgaagcatacccatataagatactaattgagaataatacccgaggtcagcgccaaaagcgttcggaccgtagaatttaccacaattactacccataccacctgaaacaccagccattcctaaaaggaaatcggtgaaccatggataagttgcattaccatccattgaagtaatagagccaacatttgttcttataattcttgttacggcaaatacgttagaaccacgcatatcaaatacgccgtgacggtatttttcttcgtcatcaacaaaaaatacatggaaacctttattcaacccgtcaaaatggtattcgccataaagttctaacgctcgtgaaatacaatcataaatttggtccgtagttaattcaacatttacaataggagcgcctaaacgacgtaatattacatcctttaattctttagggttttgtgcattataacctgacatataaatcctttagggcccgaaggcccttttcattaagctgtaggaagttcaacccatgcaccatctttgcgaacatagaatttaccgtctgaaggagcatcttcaatatatccagcgtccttaagagtttggatttcagcttctgcagcggccaaatcagtttcaagagtagcaattctagaagttaaaccattaattgtcatatcatgacttttaactgtaggcaatataccgcgttcttcaacagtcgaaccatttgggttggtgccatttataagagtatttaatgtgtttacagaacccttaattcctgtgctattagtcccaacatcagtttgaatgttctgaatgtcattactcatcccactgatagttccttcaagctctcgagtacgataaagcaaagagccgtctggttccggtttcccacctgaagcgtcaacaccaactacgttatttaaccatgacacattaaaacgcagtcctgacgaagaatcagagccgacaacagtgttcaatgctccgatagcatcagtattgagtttaatacgtccttggattgtagtaggcaaatcatcggcgccaatggcagtttctaccgtagtcaaacgaggtttaataccacctgattgattgagctcaagattaatgtcatttattgctgaactatttgcattagtggtagtaataatagaagtcgtattaggatacccaatagactgtttaatgccatccaagtcagcattttgacgcgacaaagttaaatcaataccggaaagacgactaaacactggagtagtgaaagaagtacgaggccccatttcttcgcgcaagtgttcgacttcaatagttaaagagccgacgtcagaatcagcaaatttagtttctaaatcagttaatcgaacaccgtggtcaacaattacggagctattagtcataatacggcgtttcataccagtgctatcatttcctggagtaggaaccccattaatatcttgaccagtatattgtcctaattcatttttaatccaaagcaggtcgttacgaaccgttctataaactgaatctgtttcctgattataaacaccaatatcatcagtattcgcatcaatatgttcattcaaatcattcaattcactagcatgggtttgaactgtgactttaatgacatcaatatcttgggtgttctggcctatctgtgcaagagcatcaacatccccagaaacatctaaaataccttgaataactttgatatcttcattggccgtattcaaagaagatgctatagttttaatattaacatctaacgcttctacgttacgttgaacttcaacaatagggcggttcattacaccttcagaaccgtattttgtgtcagcacctgttatttcttcatcgtttttaatccattcaatacgactctgacccgcgtctggcgggccgtcaacatatggtaaatctaccagagttatatcagccattattttaccttaatgatatagtttaaagaaatattccatggacgagtttcatttccaattaattctggacgattcatggtatatttagagttacgctgagacgctggatcaatttcatatccttcgttagtaaaatatgaacggttatcccagtcaagtcctttacgagtaccaacaaagtttgaacgacgagtattaccaaatgcaccggaatcgtcatgttcgccaaaaccaccagcatgcttatgatacgacatctgttgtttttgcacttcaccgacatatccaccggtacaacctaccgccagacgaggcttaccgaattggtcattaccattaacattagggttagttaaatggttaccacgacctgagccgcgaacaaataatccacgcatatcaggcaagcccgggttagaagagctaccaccatatcgtgtcccaattctggaagcatatacaggacattctgaagcagaaacggtcccaccatgacagaagcgccagtcagaactcggtaaactatctgcagcccacattgtaatagcgccaactggaagaattcggtccaattcattttgagtcacaatacgattgccttgaatataaccaccggtcatattgacattaccagttatattagctccaccagaaccaaccgtcaacgtattattaatgcgaagcgtgccattaatagtttgtccacctcgttggtggataacatcagcattccaagcaagggcagaagaaccatcaccacctgattggttacccgcttgtgtagttaaacgaacaactccacgtaaagaagttgtagccccacggccgtttaatgttgcgccggtcactacaactgaagagttgttactatttacttcagtctgtgtccctagtttaacgacacctttattagtttctgatgctactgaattcataaaggtataaggtgaaattgcatagccttcacgaagggtgccttgttgcgcttgagcaactgtagccaaacgaacaacaccagtaatagattcggttgcgtcaccattatttggagcaatttgcgaaataagtttaattgctaattgttgcgtttttaacggagtcattgccgtcgtatcgtcagaaccggctaatgccgcagcagaagttgaaattttaattacaccatttgttgcttctgttgacacttttgtctgaaatacattgtctattttttgattcaatttaagcggagtaattgacgcatcgtcaatagttcctgttactgcttcatcttcagtagcataacgagttaagccatattgagtttcggttgcattaggatattgtagacgagcattcagtgttgccggagtaacagctttactattatctaatccatcaataacttcttgtggagtagctatttgaataattcctggtgtagtagttgttgcttctggtacaccattaacacctgaaggagaaatagcagctaatgcggcttggacattagtgactgtatctggaaaattcgaccccgtagggtcgaattcaacgtaaatggattcgtttgaaacgtgttggtatgtattgttattactcatgaggctctcacaaagtggtagaaaacggtaggagtatcatggttatcaagagtaaccgtttgggcacccaataaattccatgttccgtatccggattttgcttcagacaaaatttcttgcgaaattgttacaccaaacgaagcatatgttggcaacacatgacgttggttatctaaatatgtcacctgaagtttattaccttcagacggatggtctttataagaagaaatagcgatttgattagcaatggcttcttgtaaagctatacgaacttgtgccgttaattcgttatcagtcataccgattgttgctttaacagcaagtccaaatacgttaataacgaccggcgttccaggggccaaagtatcgtcgagaacatcaccagaaaaagtccaataatcaacttgtgctgtaccttcaggcgatatgcctgaagtgtttgtgacaacagtaccaatatcagctcgtgccatattatggacatcatttattgcagattctacgttagcatcataaaaaccgcgagctaactgagaaatagtcacggaacctacagcttggttgtttaaaacatcaatttgagttggattttttctgtaattcaaaaaatcagcatgacgggaaataactcccgcctttgtattaagtacagtcattatgcaatccttacccaacggtatacagttatagatggctgaatattagttatagaacgcgctggaacatgagatccattagtctttgcatggtcttcacgatatttagtgtaaataggaccttcttcatccgggtcatattggcaaccgcctataattaccgtaccattatcatcagaaataagaaccttttcatcggtttgtgtagctggtaaatcagcattttctaatgtgatggttgttacaccaacggtaccacctgcagtatgagtagggttaccattgacgtcaaggtcattattatttaatgcaaaattaggatccgacgcgtcgtcattccaacctgctaatactttgccttgcccccaaattttccatgaaccaaaacctaaataagtggccggattattagggttaaccgcattttcgtaaatagtcccaacaggataaattgtgtcaaatattgctgagatagtcgagaattcacgttcatatgtaggaacaggttctacattaggccagccgattttatcaaaatcggttaatgcaacatcgccagtaatttcaatgttagacccttgagaaacatatttctcgtcagtggcatcaaggatttcttccatttcaagaagagttcctaaatcgttattaaaccatgtgatggtaataatgtcttggtcttcaaattgacggtcaaacagaattgcgctagggatattatcagtatattcaatcgcataatctgtatacgattgagtccatgtcccaccgagattagcgcatgactcttcagaatcagcatccacaccttcacaacggaaaataggagttccaacagtacccgctaattcttggagaataccattgaagcgaacttctaatgaattcgggttaggtggttctgtaggattaataccaaatgctgtaaatggaatagacctgaatgtactcaaatcagtgacgtaaatacttccgtcaatagactttttagcagtcaatttactatctaaaatgcgaacttggcgacgagtatatgaactacgccactgagaaacaccgtctaggaatgtctcaatttgtacagtgtccccaacattacacggttggcgtaatctaatattaaatccatcgagtgcaaccagttcaccaggattagcgcctggagaaccaaaatcactattatcactgaatacatcaccataatacaattcgttgccacgatgttttacgcgaatgttgttaacgttataagaggtaccgttaaaaacatccatgaaatcggtctgaccttgggtttcaaccagatattctctacgagcaacattactaatgtcagagctaactattttatcaatttgtttgttcttgatgtattcccaacgtccaggagcacaataaactaattctaaatcagagaactgaacgttaatttctaccggagatgaagaacctttaatcgtgtctccgtttgccggaattaaagtaacagggttaatgttccaagttgcaaatacgtcacgagcacgaataactttattatagtctgcaattgtccctttaggaagatttaccgaaactcgtccagaagtagtattaattgcataagatttaccccaagcagccttaagattaagaccatcagccgcatcataagtcttccatgcgccagcggcataaggaacttcaccatcacctaattcataatagatttcgtcaaagttctcatttattttttcaccacctcgacgaaggtaatcgccttgtccgtcatcaacgacgttaccaattttaatattttgtttcattattgagcgaccccaattttctgagttgagataattttaactgctgcacgtaatccaataatatcggatgtaatcgtcatagtagcaaagttgttaataatactaaagctaatattagcaatctcgtcggtttcatctacattaccaactcgcattactgcaaattcggtagaaagaacttctgagttaattgtatctattagaatatttatttcgcatgtttttatttttctaccgtccgcggattgacatgtaacaagcaatttagccatgttataatctgtgcgataaaacagaggaatagaaactgtgtttcctgtaagactccaagtcccatcgacaggagattctttctgcccaaacatgctatcagtagaataattccatactgaagttggcccgttaagttcaacacaacgaagaacaacatgggtataaggggttgaaataacaagattattaagaacacctttaatcgaaccatcggttacttggatacttaaaggattgttaacagaaatagacccattagagtttatgaattctacagagtcacctaattcaggacggtcaataataacaatcacaccaccatcagaagcatcaatatcatgcatagtgcctggtttaataggagtttgataatcgaccgcctttcctttttgataataacctgtggcatgaatagtttgacctgtaggtccggttccatctgctacggccattttacgttgatcgccaaatgcattgtaaatagcgttgatatcgtcatttattttattaccaccgtcgaataagatatcacctgttgaggcattaccaatttcgccggtatcgattaattgtttaggagtttgcttaaaaaatgccataattctgccttttgttgtccgatattatattctatttatagatacaaaaatgggagcccgaaggctccctaattaaaacataaacaaaatgttaatttcttctgtttggtccattgccataataacaggtggtcggttttccatataaatcatttcaccagaatgacgttgcaggtctctagggtcgtaataatccttttctgctttaacattagggtcatttggatttttcttagcttctaacgggtttgcgataattgatatctgtctaaaacccttgttaccaggcaaagctgcctcagggaaataaaccgaatcaaaatatgctttaaaccgcatcgtattagctttaacacggtaaatcaagccgtagtcgtcttgttgccaagttaagttattttcatatccccaacgggtggggtcttctttaatttcttccggccatggaactacaagatattcattagtgcaacggttaattgacacatcggcaggaatctcataaaggtattcccaaatatatccatcaccggtttcgataaccccattagcatcgcctctgccttcaggaggagacatagaacgaacagacggggtccatttaccacccaatttaagacattcatctttattatctaaagattctattgaacagagccctacgtcagggacatctaaacaacggtaaattaaccaaccggctccaacttctgtcgcgttgtacggagcagtattacatgcgactatatcgttaattctaaacgtgtaagggtctggatatcgcacatctccccaatcacgtctaggaataacagaatctaacattgaaggtaaaactttaacggtacccatcatatgggtccacatatcagtaacaccaagaacagaatctgtaggataaggtggggcgaagcccacctcattttcatttgacgcccaaggctctgaacgtccaaacgtaatataaatggagttcttatcatctccatccccaactgaattataaaaattcagcattttctctgttctaaattttgatgtaactattgcacgatagataacacttgaatcattcatctaatttaacctgtggtggattcacggggtctcttggatttcctacattatcgattaaccgttgttcaaccaaatctctaaatctagagaatgttgttccggacgcatcaaataatgggctcatcagtttacgtcgttccgatggaagttgaccttgaaatatggagttattgttttcagcgttataatcttcaggcaatggataatcttgaccagccatagggcctatttcatatatcgctttacctgtaatagggtcaaactcaacatttccttgtgggtctaatttagccactcggtctgcatatttagtcggtaatccagaatcccacttatagtttttgtatttattaataatggtttcaacatgtttaagtgttaatccggtgttaataaacattgtgagaagggtaattgcgataaatccaaatccaaccggatgaacaaaacgtaatacgtctgatttccaacgagatgatggaagtttagatttaatcttcattacgtagtatgctctaccacgatttatgtaatcgatgttgttctgagaaagctctttacctttaataccacgaacaatttcaccttcaaaaccagggagtctttcagctttaacttcctgtccttggattaaacgacctaagaggttgtgaattgttacagtccattgtaatttacctttagagtaacttctctcgatatacgtcacattacaacgtcctgtagcggtgtatatggtttgtccgaccaaatcttctgtcaacgaatcagattcaatgatgatatcatattcggtcccggaactagattcaatttcaatttcaacatcttcgttataaagcactttaaacaagaatttatatgacgcttcggttcctttagttgaatagaagtcataacttcttgattcaaagaaacgagacactaaatcgcgtttttcggcgtttaagtaaatgtttcgtttataaatctcagaccataaatattcccacgcatgttcttcgcgcggatattgatttttaataagattcaaaaggttgttataatgggtcccataaccgtcagaaagatactgaatataagcctcgcagaatgcttcgaagtttgtattatctaaaagataagactccggcatcattgtagtgagcaatggtcgtaaatctgggtctgcaataccattctcttctacaggagtccatgtggtatctttttcttggttttgtaacgatgctgttaagaatatattagtaggcttccaaattatagaaacattatctctaacacgataactaaaatcgtaataagaaataatctcacctgatgatttatagaaaatcatgccggatgcatattttttaaatccggtgaaatctacgttaggcatcactattgtacagtcaccgtccttccaatattcatgaacttcacggtctgaagaactaagtggatgattctcaataaccttagtgtaaagtaaatcagaataaattacaacagccttgtctgagttattaatccaacatcgagtaccggactttctagaataactaaagaatggctcagcatagtattccatcggttgaggagtgaacgattcccattgagagtcttcagttgaaataaatgccatcatatgataatgtttatcagccaaccattcgcgaggatactcatatttaacagcaccgattaaaccgtacttgatttgtgtttttgggtcatcaacaatatccgattctagaaatttaaaattactagatgaaatagataactcaacaccatcagtagacatactggtgtacccaggttcaatacgacggcgttcttcttcagtattaccaaacacacgtttaaatgtgccagcatcatggtctagaacgtaaacgcccttatcagcagaatcaacaataggagtggtcctcgggtcgtcattaagattaacaacttcaccgataatcagtgcaaatattttaccgccgacagaatccattttatagcaaactgccttagggttacctgtgatgttaaatgtttcttgttcaaacaaacgttcggaatatgtcggagataacgggtctgaatcaataggggcattactagttttaataaaacgaactttatctcgagcagcaacgtatacataatcgtcattgcaaacgatagcttctgcaatacgtgacacgttagcaggtaatgatgcgtagttaccaaatatttctacatcaaatcctaaatttaactggtcaccaattttagcaaatgttatatcttgagaactaaatctcacatcagcagaccaacgaacgtcagttgatttacggccgtaaaataatttatcatacccaagaacatacgtggtataacctgtctggtaatacactgttcttgatacagggtaccctacacggtcattaaacaatttaaccgatttccaggtttgtcccttatcattagagactttaaccacaggctgatatcgttcaaacaaataaagaattccttcggattccatcaaataaacacggtttatatcatgacacacctgttgaatcgaaccttgaatttcatgatactcattttcgccaataatgaaatttttaatagatgaaatatccgcataagcagggctaaattggaacgattcattcattagagctgccattatagtgtcgttattaaaatcgacataagccatgttgttatttgtaaatttttctctaataaaagtgttagccaattgcatttcaatcatatgttgaaatgtatacgcgttagtctgaaatgattcaaatatttcggtatatacccaatcagatctctcgaagccttcggcggcagttgatacacgaataatataagaagttaatgggtctaagctactttcgaaccagttgctattaggagtatatcctaaatttatccatctgtagctggcacggggaattatttccccgtctgccgttttagtctcagcgatttctacaaaatagtagaaattagcaccaacgtcatcccagcgtatttgaacttggttagcggacaacttggatattctgagacttgtgactgctggcgcttttactgtcattgtgaaataggctccaaatctatagttaagtactgaggacgtaagtcattttcgaatacgattaacgaaccatcctttgtaaaaataatatcatctgcagggtcggaataaagttcaattgtttgaacttcaaaacggtctgaagtgaggtcaattttagcaatgttccaataaatcgaatcggcaggataattcacttcaccaattgaatagtatttgtttcgtccgtcagtaacagtaagtttattaaaatcattacctgtataaggttgtatattttcgttttcaacaacatcgccgtctgcaaatggaccaataataacttgacctatgccacggtcattacggtcagaagatactatgcgaacaccatatttaatagtttcgtttgcattttctggattaggtctgtgcgaatcaaacgagaatatattagattccatcgatctatctttaatctgattattgtatttaataccggcctcaggcgttttatagaagttttgtacttcgcgaaccatttgaatagtagctgaagaaccaataatagaaatatctgcatcgtcgacataagttagcattttagattttgcaaacgatgagttaaaaatttctacatcttcaatataataacggtctattttattaataatctgcccttcaagatattgttctgattcttggagtttattcaacgcgtatgtaactttgatattcattttgataaacaaataatcaggcgaaataacaacaggtgtaatagtccctaagttataatcatttaaatagtttttgatatcatcacgttgaacagaagtcaaatacaatccagatttaggcttagcagcaatatatgcgtaccctggtttagatgaatctgtgaatgtttgaaccgcttgaataatagaaccaaaccgctcagaaacgaatgtgtcatagtcggaagcggttacacaacgttgttgagtttcgcgtttaattgtgcctaattcgcggatacgttcaatatcttcagggtcaccaccaccgtcggccccaacaaagtctgggttattgctagggttctcgttaatatcgattaccgtgatattagctaatgtatcagcataagaaaatcctacagcaccgttagcatctgcgccattagtagaaatatactcaattacgattttagaaccctgaacaggtttaaggccaccaatatagttagatgttaacgcaccttctgacgtgttaatagagatttcgccttcaccaaaataaaattcggtgttcccatcaactgtttcacgcatataatagattgttgacgtagaaccagcgtgaaccatcgacttacgagtccagttaatccattctgctccgtcaacatacaacttaaccaaattacggtcaatattcttatcacgaataatgataggttttaatctatcaaatgttaattcagtgcgaacaatacgtccttgagctaatcgaagacgtggaaaatattggttatttttgtctttaactacaatgacatcttcagtagaaacaaagttatacgggttaacagaagtatctttagcgtatgctaagaaacgagtgccacgtggaatggtgatatagtttctatttaatgcatctgtacatgtgagcataatttctgtttgtgctgctgatttagatgaaggcagatatccgttatcttgagccgcttgcacaacagaactacgcaagtttgcagtacgcataaaactttcatacactgcactattactgaactgttggatgtaaagagtgttatatgctaaaaggtcgcacaatacgtttaagcgtgaaccttcaaaatcataatcaagaaattcgttctgtccattgagccattcgataatgttctgtttgatttcggcaaatgtgcccccgataaaaatctcgggaatagcattcgctgttcgtgttaattgataatttacaggagtgtttgccattttaattcctattttataaagacttttgacgaggcctgagaaacagtatccccgcatgaaattgggtcagccatttgaacggcctttttaccggtgacgtatactttagatgtacgaggttcagtaacacctccatgagtctcgtatggttttttaatttctgtatgaggtgttatttggtctcctgccacaagaacaggaataccgccggtgaacactttagattgggaagcatttattacagtaggaggccatgcttcatgacctgttgtaacgcacttgtcgtaacttaagccagacattttcacggcctcacataaacatagtttcgtaattgatgagcccatttgctccaatttcctactatagtttttgtataaaccttagtaagagttttttgtactggagccggtggaggttctgtaccagagtcacttctagaaccgcctgatgaactttcttcttggtagttataaatcatttcaaccgtataactaaacactttacgaagattctgaggagctctccacaaatataactgtgtggactcatcttttggtaaatcatcccatgaagatgcggtttcaaaatcatcatttaatcggtatttcaatgcgtccgaagaaaagctaaacacactttcatatgttccatataaacgattaccatctaccgtaatgccttgtgtcggttcataatctgttatatttattgacactaaagtttcggttgtttctaactgtggagtaaaaaggacgtcaatagacgccccttccatgtcttctcctaagtcggtatttaaaggaagtatttgtgccatatattacccaatatcaatacgagatccgtcaacagtgtattgtcctgaagctactgagctcattgtagacattgtttctgcccaatccccggcaacagtcatatcaacattaccattaacagtccatttaacgtttccgttgacggtgtaatcatgattcccttcgacctgagttttagcatcgcctttaacaagaatatctgcatttccgtcaacaactattttgatattacccttaacgtaaagagttccatcgccttcaacagttttagattggttaccacgaataaagattgtgtcattgccgtctatttgatggaggcggtctgccatgttataatatatttcattagcaccaacgttaacaagcttatcgccagaaatcaaaaagttcccatcaccattagtgatgtcaaaaaggtcttctacagttttacgagtacgacgaccagacggagaaacttcctcatatgaccctgttggatgaactaagcgataacgttcattacctggagtatcgtcaaattcttggatatgaccactttctgtttccatagcatgaacgtatggatactcaccacgataacttgattccggttctttaaaaaggatgcgtgaatctaatggaacaggaggaccagccgggtcttctggatcggtatttctagtaactaaatcggcaccaactcctggtgaaggcggcgttttaacaggaacaccgtatgattccatgttaccggttaaaataattgttgttacacgtgaagcacgccctttagtctgttggaaccataatgaatcgcgtccagatttgtatgcagttttccaatcgccttcggccattgctttaagcatagtattgaattttgctacaccaccaacgcccatttggaagcacatgttttctaatgccatttggcgagatctgttcattttagcataaacaggacctactttagaattagaacgaatatctttctgcatcttagcaaggtccttctcaaataacgctgttgcttcttctaatgtaatagttcccggatttcctgttacttcacgccctacttgatcagataacaatttattaattcgagacatatctcgggtcttttccattacgataaggtgcccaatacctactgtaggatatccgagatggtcccaatacactttatcacgaagaccttcgtcacgacgcaacatttctgttattgtaaaattagggtcatcatcttctggaatatttgctaaatctgtatcgtctgggtttataccataatccaagttgttatcttgaattacgttagagttcgaataataaccagcttcaccaccttggtttaatacgttcgtatcattacctaaacgtcgcggatactggcctgtcgggtctgaaaaaccttcaagtctattaggcttttcacgtacgattccaccgtatgtaccaagtacaatcccgtttgttttccatttgtctaagaaatgaccatatactcgagttccttcaacaggacctgtaacagaaccaccaatacctgacattgatgcagacgtaataggttgaataacagtcatccatggaagtttttctgtaggaataccttgtacatcaccttgtgctctctgcgccggatgaagaccaacgactctaactcgaactcgcccttgttttaatgggtccattctgtcctcgacaacacccacgaaccaattaaggctactgctaatcatttccattatgcaatctccatctcacgaatcaaatcagtaataaacgagtttatatcttcttttgcaacaatttttattttacgaagtttttcgttatctaatacagccgcttcataaatatctactgcagctaaaggtcctttatattgcggatacttacgagcttcatcacctttatcgtaccacactaaaggctcgtctggatatgaaactaaattgtaaaatttctcacggttctcgttaatatgataaagaatttggtcgccgcctgcattagcatatttctgaatagaagcttgatacgctgcttcctgagatgtaatccaaccataatacgggtcgtagttgtcattacacatcaaaagaacccagtataattgagggttgccataaatgatattcgctagttcttcaggacgcggagagcctttaatataataagaacgtaatctataattggcagcaacacgcttaaagtactctttatagttacgaaatatgtctgtcataggaatagtaggtgcattcttatcaactgttttagcactatatcctattgggtcgaagaatgtaaataacaagatagtctccttccaatatgaaattggtataaataataatactatttataaggaggacaacatggcctactctggtaaatgggtcccaaaaaatttaaaaaaataccgtggagaccataccaaaataacgtatcgttcaaactgggaaaaattctttttcgaatggttggataaaaatccagaaattattgcatggggtagtgaaacagcagtaattccatatttctgtaacgcagaaggtaagaaacgtcgatactatatggacatatggatgaaagatacatcaggtcaagagttctttgtagaaataaaaccaaagaaagaaactcagccacctattaaaccggtgaatcttacaactgcggctaagaaacgttatatgaatgaaatctacacgtggtctgtgaactgtgacaaatggaaagctgcctcagctgttgctgaaaagagaaatataaaatttcgagttctaaccgaagatggtcttagaaaactcggatacaaggggtaattatgagcatattccaaattatatctgaaggcgtacaagcccctaagattgctcagtctatgaatgaaagaaaatggattgagataggattagaatacaagaaagctaaagagaaaggaatcactgcaaaagcatttgcagaatcaaaaggaataaaatactcgtcgtttacatctgcaatgtctagatatgcatcatctattaaaactgcacagaaaattgaaacgcttgaatctaaacctaaaaataaactcaataagcaagaacgtcaacttctgatgataaactcgtttcgcagttcaatacgagaaaagattagaaatgaaggcgcagcagtaaacaataaatcatctaagtggtttgttgaaacaattaaaaaaagtgtaaaaggtcataaagtagtcaagcctacgccaggcaaaatttatacttacgtgtatgatgctaaacataaagatactctgccgtattgggacagatatcctttgattatttatttaggattaggtaaacataatttgatgtatgggttaaacttgcactatatcccacctaaagcacgacaacagtttcttgaagaattgctgaagcaatatgctagcacaaccactattactaataacacaaagttgaagatagactggagcaaggtgaaaggatttcaaggtgctgacaaaatgattaaagcatacctgccaggccacattagaggaacaataacagaaatagctcctaaagactgggctaacataatcatgttacctactcagcagtttatgtcaaaaggaaaacgtttctctgcgaatactgtttggaaatcttaattctattctcttccgttcttctgatattctgttgaaccggattaatggaagagacctaaaaccattatactgcatttttattaaagcgtttttgaggtgcttatgactcgtccagcgagacagatttttaaccaaacaaatataacaaactttgttgtggatatcccggatagtacacgaacttcaggttttgtgcttaatgctcaaacggctccattacctggtgtgagaattcctgttgttgaaactgtgacgggcacaatggggttaggacgtgcaatgcgtgcaggcaccacatttgaatatgacccttttgttgtacgatttatagttgatgaagacatgacgtcctggatgaacatgtataaatggatgctcagcactaataactatataaccggtcataatacagcccactccgatggtcctgagtttgttactttgcacattttaaacaacaataagactgaagtagttttgacggcgaatttctataaaccatggatttctgatttgagtgaaattgaatttagttacactgaagactctgaccctgccgttacatgcgtagcaactattcactatgcgtatatgacgatagaaaaggatggtgaagtcattgtatctcaacaaccacgtcaagcagtcgaatctaaatccatttctagacacccttccttgcgttaatcgcttctagctccgtatgttataatcactcataaattatatgaggaaaacctatggagctaatctttttaagtggcatcaaacgtagtggtaaagacactactgctgattacatcaattcaaactttaaatccgtaaaataccaattagcatatccgattaaagacgctctagcaatcgcatggggtcgtaaacatgctgaaaaccctgatgtattcaccgagttgaaatacgaatactttgaaggcattggatacgaccgtgaaacaccattaaatctcaataagttggatgttattgaattattggaagaagcgctaatttatttgcaaagtcattatttaccgattaataatgttaaagtattatcatcgttagaaggtggatattcgtatctagatattaaaccatatgaagccctgcgcgaagctataaataatatcaacgacacatggtcgatccgccgtcttatgcaagccctcggtacggatgttgtcgttaatttatttgaccgtatgtattgggttaaactttttgcattaaactatatggattatattggaagtgatttcgattactatgttgtaaccgatacacgccaagtccatgaaatggaaaccgctagagcgatgggtgctacagttattcatgtggttcgctctggtacggaatccaccgataaacatattacagaagctgggttgcctattgaagaaggcgatttagttattacaaacgacggctctttagaagagctttattctaaaattgaaacaatcttaaggtaataaaatgtctactgaaactatcgaaaaactgcagtctgaaatcgttactctgaaatctcgcattcttgatactcaagaccaagcagctgctatccagcaagaatctcagcaacttggtagcgctcttgctaaaatcgctaatctggttggtatcactggtgaatcagttaagattgatgacctggtagaagcagtacgtgaacttgttaaagctgaaaccacagaagaagaataatgaaatttgaggacttttcacaaggcctctacgtcgcagctaagttttcagaattaacacttgatgcgctggaagacctccagcgtaaattaagaattcctaatccagtaccacgtgaaaagcttcattcaacaatttgttattcacgtgtaaacataccgtatactacatctagtggcagttattctgttgctgaatcagggcactttgaggtatggaaaactgacgacggcgctgtactggttttagttcttgattctgaatatcttagatgtcgtcatcagtacgcacgagctttaggtgctactcatgatttcgacgactacactccacatataacgttatcatataacgttggccaactatcattcagtggtgatgtagctattccggttattctcgaccgtgaatacaaagaacccttaaaactagattgggccgaagatctgaaataattttcacaaaacagtttacataaggatgatggtgtgttactatcatcctatcaaataaacaacctcaaggaaataaaatgaaaacctataaagaatttatatcacctgttgctaatgtttctactctgaccgaagcaacccttacttccgaagttattaaagcaaataaaggacgtgagggtaaaccaatgattagtctggatgacggcgaagaagtaaaaggtactgtttacttaggggatggatggtctgctaagaaagatggcgctactattgttatctctccggctgaagagaccgcactgtttaaagctaagcatatttctgtagctcagcttaaaattattgcaaaaactcttctgtaagtagtttacatgccgataggactatgttatagtagtcctatcaaaacaaatgagtaaatggagaaataaaatgaaacgcgctgaactgattcgtaatgttgctgtagtaattgcttcaatggcttttagtttttcgatgtttgtaggattcatttgcggactactgacaacaacagaaaattctatctcattggtagtagcatttctaatcggtttaatcgctattgttatggataaaattgcaaaaggtgagtaaatgaaatatcacatatatgcggattttgaagcaaatccttctaaagaccctgattgtcgtttgatacgcaaaccatttgattcagcagctcaagcatgggcttggattaaatctaaatcgcctggttatatgttctttgaagtagtcgatgacaatggtacactgcatccagaacctacagaaactattaatttccttctgtttgctggttacgactgttatcctcttggcggtattgacgaccttgttgctacaggaaaaactgttgaggctcttcgcgaaatttataaaaacgcagaagaaaattttgactggtatcatattgttgatgctcatacctttgaaatggtggaacattcatgattctttatgctaaagtatcgtccattgagaatggatatgaaagcgaccgagctgcagctaaagcactagtcgattactatggtattttgacccactttgaagttgaaaaggtttacgtcgaccgttcatcttcacaggttaaattactttgggaagaccgcaaatttaatagtgtgaactttgatttctttattgaaacagaaaaaggccctcttgaatatgatattttcaagaatcctttgaaattacgttgcattgaatataattacattaatatggtacggtgagtaaatgaatatttgtttaggcagtacaattcctaagggttacgtaattgatgtcactacttgggaaaatgacggcgacaactataaaactaaaacgttgtttggtgtagaagagcatgagctccaacagtttaaatatcttttgaagaaatttaagagccgtcattccagcactaaagctgaacgttactgtggtaatacactattcagtgattgttcgcttttaatctatgaatacttggttgaaggattgttctcagaccagctttatccagaattcattaaaaaggtctttgatattgaagtcgaccttggtaataaatctgaagaagacgaatcgcgtgtatttgacctgttccatgagaatggatatttagtatcagaaggtctcattgatattcttggccatgcttctgaatattatgattatgatttcttgcgtgtagttgaatgtgttgaatttgcttatattgaagaagaaatcgttttgccgactgttaaaatgattgatttgctttaagaattatgtgttattattaattcatacactctattaccaaaggtgctctaaagtgcctttcataatagaaagttatttaggccctgtagctcaatggttagcagcagtcccctcataagggaaaggttaccagttcgaatctggtctgggccatatattcgaggcatagctcaattgtatagagcaacggacttctaatccgtaggttgaaggttagaatccttctgtctcgaccaactttaagtgaggaaaatatgaaaggtaatatttatctggtagttcatgatttaacgttttattttaatgaacaggatacagttatttccgaccggttgattaattcgttatatcaacacgctgattacgtttatttccaaaatgaatttggccattggaagtttcttaaaaaccgttccgggttaactagttttgaatactttgaccgtaaagaccttttaaacgaaattccattacaacatcggttccagaaacgcgaatcactatactattgtcgtcatataccaaatgctgaatgtgtttatgaagcgattaatctatggcgtcggcgtcgagagcaaattgatgatatgccaaaataagaagccgggtcgctaccggcaagtcgtcggactgatgttccctgagtaaggactggtcttaataaatctttacgatttgttaatatccccttacatcacagcagaaacggcgcaccgaattatcgattcgaggaaatatctttgccgtaagccgagtagcgtttttgacggaacgttcggatatggtcgagatatggccttttaaaaatattgagtagcgtcaactgcttaataaccgggttcaaatcccggcgtttcgtacaaacacttacctagtaggtggaaccccgacaaggttgccgcaaggcttagccccttccgaaaggtcggggctttttggcataataataaatagataagttaattaacttaggaaaagcaacatgaaatcatacgctgaatttttgactgaacaatctagttcagatgtaaaagccgctgcgattgcagcaattcaagcaggtaaatattcttacaaagacgcctctgatgaagaacgtttccgttttattagagattttaaagccgaaggttttactaatgctaatactgttagccgagtttttaaaagcctagctgcatcaggtgaattgttccagaaagctacaggtaaagcacctgcgccaaaaacagaccctaaagcagctcaagaaaaaaatatcgccaaaggaattatttctaagtatgaagcaattcttaaagagcttttagtaatcaaaacagaaggccagaaactggcacgagcacatagcttcaaagataatcctcacgctcatagccttgagtatgttgaagatatccaaaaacttattaaagaccgtatctggtctgctaaacaaattaaataatagaatgccccttccttatggttggggccttttggtatctagggcataaaaatatttcataaagatgtttacttcttctaaggacatgatactatagacttatcaaccatagaggaaaatgttatgagtctttacactgaactgaataaaaaatctgaagaatctgctgaaactatttttaaaaacgtgcaaaagcgtattttggaaaagatgtacgatgcagcatctaaaggtgaaaaatcttgccggtttccgatgaggtgttcttctgatttatgcgcaaatactattgaatggctggaaagtgaaggtcttacggtagagaaaaacccggcgacttctattgacggcgaatcatatattagtatttcttgggataaatcaagggtagaagagaaagatggtgattgggttgtagatgttaaaacttctgatggtggacgttctgttgaagtttcagctgtagttaaaggtacccacgaacaaaggacttggggttggggtggtgaagaaaaagaaattgttcttagtgtgattgccaggtcaactagtaataaaattgcacaaagcatcattgactctgcaattgctgaagcagaaaaaatttgcaaaattaaaaataaatgatgtacaaacgccaaggatggtgatactatagacttatcaactacagaggagtaaacaaaatgactactttaattatttggttcgatgaaaatgaagaaacatactgtgtgaatattggtgaaagtccaatgcctgaatttgaatcctcggataaaaactctgttgtatcttgggctgaaggttataaagcagctaaaggtgacgttgaaataatttacatctaagtaagtttatgttatagtaatcacataaaatcaagaggaaaacaaaatggctaaagttagtattgatgtcgttgattatgaatacacagaagaagttattcgcaaccgacaccctgaagttcgtatcgattcagttcaagattccaagttctggacaactgagcttaatctgagtggtccttatgaagctgttaagaagttcatggttgaagaatactgcgaaggcatgcaccccgaagacgccaagttttatgtcaatttgattaaaaaataatttacaaactcttgagagcagagtataatgctctcgttggataataaaccaccaattgaaaggtaataatatgaacacactgaagaaacttgttgaattcatccgcactaaactgggtactgctatggctaaaaatctgactgtcgaagaacagtataacgcagctgcagataagttgattacccaaatcaaagaactaaaaacggcttctgttaaatctattaatgaagaaaaacgtattcgcgaacttgttaatgaaaagaacaagcaagccgcttctaaggaacgtgaaattcgtaagctcttggctgaaggacaagatgttaccatgcatgctaagcttggtcttctgtatcgtcgaactgccgaacaacttaatacaaaagctgacgggtatgccgctatgcgaattgaaattgctcgtaaggtggttgaacttgatgatgctcgtcagaatctggcaatcaaacttgaatacattcgtgaaactcgagcagccaatgcccttggtatctctacggccgatgatgtaattgaaatcgctgcactgactaaggttgatatcgaagacactctgactcgtgttgagacgttcaatggcactccagccggcgtcgaaaccacttctgctgatgtacaagaatatattaactctttgaaataaaataatacggaggactccggtcctccttttggataataaaggagttaacatgcgaaaccaaaataatgatattgactcaatgttcgaagagttccgagataaggtaaatccacctacgtctttagttgattcattacgatatgttgcaaccggacgtaaatggtactggtcgtcttcttatgagaccaccgagaaaacggctagccatagcagaaaatctttattagccccaggtattatgattcatgatatcggagctattgctaaactagttgcagaccatgatattagattcactgatttcgttgctcctacatggtctgtttgttgtttaaacactgaatgggaatatatcagcgaacgctctgaagattattatggttttagagataagcttctgaggtctaatatgttttatatcgatacagaagttctagtcgataataaaaaatattactttacgttaatcatcgattctgaaactatgtatgaaggcaagcctttgcttaaaagagttgatgctttaagtgctattgatgcgctttatgaaactatggttgttagtcctaatttcactaacaatttaatccttgagcaatttattatggaatgtagagaatatgtcaaagccaaccctgtacatgccgattaagccctgggcatacgaatacaaacgtaaattaatcccaaacgaagtactatttggccctattttagctttagcatttttaatctttatgattataggagctgttttagattctagtgaagttatatcgtctgatgcagcattttcattaatgttcgtcgcaccacttattgtaccgtttttattgatgcctattaactggattggatattggcaccaaggccgtcatcacagagctcgagtaagagaatggagagttcagtgcgcaaaagcccaagctcagtatgatgaagctgttaaaaagtatgaatatgaagaagctatggaattcgttaaggaaataagatgcaaaagcctcaactcttaaccgtatggccgtctcttggtgagaacattctaatttttattatgagtattggcatgggatttgcctttggattagttggatttcttattgacggcgttgtgttaggatttatagggaacactggtggattcacagaccaatggcaggacttacggtatacccaagcctttgcatccatcgcatccttttgtactgtagtctatttttactacgattttataaaccataacaagaaaaataaaaaggtttacgcttctcaaatgattagttataatgaactcctagctagacgtgaaaatgaaacaatcgaaaactttattaaggaatgtagaaaatgagtaagattattgaaattaaagtaccagagtttaatgatgctaaatccgcttcagatgcaatttataaacttctgaatcaagctgaacgtatcgaagaagaagcaacaaagatcgcagaccaatatgccgtatcattttctgtaggtgattatggtagcggtcgtacttattatcctaagggtgaaatcgtatcccagtggatgaaagatgaaattgaaaataatggtggcgatgttaagcgtgaaggtaatggttacgttattactgaaggtgcttgggtttcgtcttctgcgttgtgctaaggaatcattatgtctaaagaacaaaccgaactggctgaagctgtagcaaaaatctatgcagctattgaggctgccaaagaaattgctgataaacaaaacacaacgttcaacttgtacccagcttatggtatgggtggaacctatcattcacctggacatcttaaagccgatcttgaacgttgtacaaaaaacggctatgctgaatgggctgacgtttaccaatacgactacaacctgagcctcgaaactggtggttgggtcgcatcttctcacacttgctaaggaaacaatatgtctcgtgaattagattgtgctgtacgtacggcagtagctgctctggaaaacctgttccaaattgcaacagaagaacgcgaagaagttacattatggattgaagataacgcaggtctgaatctccaggacgcgatctcattatcccacaatagtatcactgttcaaggctgggtatcatctagttattcttgctaaaacagtttacaacaagatagggctatgttatagtagtcctatcaaaacaaatggagtccacaatgatttattacgaaagtatcggaaccaaagtggttggtaaaaccattactcgtgaaaagtttgcaaagatattcgatatgcgttataaaaaatctgaacacaaaggcatccgattcgaagatgcgcactgtacaatttgcccttataatgaagacataaacggtacaatcgttccattggtagaggcttcacatgatgacctctgggatgaatatgatatcgcatgtcgtgaaatttaagttaatgaattaatccgaggaaaatattatgatgttagttattggttctcgtgcacttcactatcacggtcttattgattctaacgctatcaaaaatagcgattgggacttcattgcagaccaaggctcttggaacgtatttaaaactcaaatgatgggtgtatatgttcaccaagacaaccctggcgtccaggtattcaaatgcttccataacggccgtgaaacccattttgaagcatacatcgttccggctatcactaacgttcgcgaactagtcggtgaactcactcctgaagatttcacatcttcttatgaccttttaaaatatgccgagaaaaatctatctaaagaccgtttaaatggattttactgggcaactcctgagatgtgtcttgcaattaagatgtcccatcgtttcaagaaaaataatccgttctttttaaagactatgaaccatattcagtatcttcgtggtaaaggtgttacactgaacgatgaacttactgaaattatgctgaaacgccagaaagaaaccttgaactatgctcacccggttcttgacacttctaaaagtgcgttctttaaagatgacatctatacatatgaccatgatactattcatgaagccattgcactaacagaccgtccagcgtatacattttatatgaaagacggttctgaagtcatgacctcacgcgagaagttcgaatcattaccagaaatggtcaaattggccggcgtatacgaagaatcatgtgtactagcgttagaacgttcacagattcctaacgactttaaaatccatccacgtgatagttttatgatggcccttgaaaaggtctgtacatcaatcacatcaggatggttccgtgagttcgcttgggaaaattatagcaaagtagtaagtatgtaccaaagcttaggacacgacgattacgtcaaacgtttcaaacaaaatttccatatggtaaaacctttcaaataatttcgcaaaacagtttacaaggtctgtagttgttgatactatagacctatcaaaacaaatgagtgaatggagatataaaaatgactactttgaataaacgtttcggtaaagctaaacctggttgtgcagcagaacgtcgttatgttttcgctcagttagaagatgtagagtatcagattaatcaagttcacattactggtatcgagcctatgtgtggccttgaagctcttcgtgaagttcgtgatgggtatcgtcgtgacatcgaagaaatgtcaaaataagtgtacaaactgatagggctatattatagtagtcctattaaaacatgaggagaatattatgaaattaggcgaaaccaaccgaattggccttttaacaatatttgcatcacctttttacgcagctctttctgttgcagtattacaaaaggcgtacgatatggatggtgttcctggttttgtattcttatcgccgtttttgctattcgttggagcattgttattatatgccacgactagtttcgaccataatgtctgggtcaattataaatgtaaattgtctgaagaagaacatgccgaagctcgtaaaaaagctattgaatctaccaatctagaaaatttcattaaagaatgccgaggaaaataatatgaatagttctaaagtgtttaatagtcaagctcgtgcagtaggtagttttgcacataacgtacaaaatgaccgaatcaaaaatgaaccaatgttctttaactgtgatttgggttttgcttgggataatggtggctcaatcactcgtagctttattgccaatctcccaattgattggactaatcaacatgttgtatttgattctcgggttcatatgctgatgcctggttggtatcctgctattcctggataccaccatgacgatgttcctcgccctgatattccagttggtcaacactttattactgcaggacaacctgactatgacaaccctcgttaccattctgaacatattcttggtcttgttaacgctgacgtgtgtcctactcattttgcaacaggaactgcagagttcagtcagattcctgatggcgaacttatctatcgccagtggcacaaagaagtcctcgaaaaaattgaaaaaggtgaactagagaaatgggaagctccagatcgtactcttcttcagtttgattggcaaacatggcacactggttctcgtgcaattagtaacggatggcgttggttcggacgtgtatctcgtaatacagaccgagttaaaaagattaccaatgaaattcgtgtcaatgctcaagtttatctggaattccctatggaaggctggtaatgattaacaaaacatattggtctaatatagacgatggcaacgaaggtatttcatactattcagtagattggacaggatgtccatcctacttagtgaaacatatttgccaagaatttaaaatcgaccagccagcaggtattatcgtgaacagatacattaatggatatcaacctatcgatgaagtaatacgaacaactcaagctgagcttgaaaagtttttcaataagtgccaatggataacaggatggattatatttgtaccgtcggtatggttttttagtactaaggtgagttctttcggttttgttgatattattgctatcttattagcatctactatcgtaagtattattggtggtattattggtggaggtactgtaggcatcattattaatcttgttaaaagtagtttacaggaacgtaaagacaagataaaggccaagaataatgaagttgaacgttttattaccgaatgcaggaatttgagatgagtatagcaatttacattaaatcagaatcatgtgatagttatctgtacacatatgataaagatgtgtcagaagaaaaaatcaaagacgaccttaatatggaccttgatatgttctgtcctattgccgattacaaacttgcggtctctaatagtgaaagtccatctaaagaaacgcgcattgaagaatttatgactgaattaatggccaaatcatgggaccgagatgatgagtaagaaaaataaagtgaaagaactatcagccggtattattttccttaccgaagataaagaattattcatggggcgtgtaactggttctcgtcctaaaggttctttagctcatcggtgggatattcctaaaggacgtgtcgagcccggtgaatctcctattgaagccgctattcgtgaatgcgaagaagaaaccgggtttacacaatatgaccctgccttcctgaaagacctaggcgaacatcattactcagacaataagaatattcatctgttccaatataccatccctgtagagcacgagcaattcagaaacagtgtttgtaattcctatcatacattccaagacggacgacagattcctgaatttgatgcattcgctttaattaaaccttctcaatgggaatatgtaatgggcaaatcattatataaggtgctcactaccctcctataagtaataaatacctcctataaacgtgggaggtattatgaatatatttgaaatgcttcgtaatgacgaaggtcttagactgactttatacaaagacaccgaaggcttttggacgattggcataggccatttagtaacaaagaacccgtctttagccgtagctaaagctgaacttgacagaatgatcggacgtaaatgcaacggtacaattacccttgatgaggccgaaaagctatttaatgaagacgttgataaagccgtccgcggaatcttgggtaatgctaaacttaaaccggtatatgattctttagatgcagttcgtcggtgtgcattggtcaatatggtcttccaaatgggtgtatcaggcgtcgccggttttactaattctcttcgtatgcttcaacagaaacgttgggatgaagcggcagtaaatctagcccaatctaaatggtatcgtcagacacctaatcgcgcgaaacgcgtaatctcaacatttaaaacaggaacttggaaagcgtatatatgaaaacatatagtgaatttttatcagaatctattcttaacgaagctactgacacatttgcaactaagctaggtgcagctttggttgaagccgaaagtctactagcacgtatttctgaacttgctagtaagatagatactcgcaaatttgaacgtactagcgatatcgctaagcttgaagccttgttacgtatgtgcgataaaccggaagaaatcgctaagaacggctcgctgatgaaacaacgtcttgaaaaatatatttcaggcgcttcagaaaaatagtgtttacttcctccaaggactttgatactatacattcatcaactacttggaggaaattatgactcgtatcaatttaacacttgtttctgaactgaccgaccaacatcttatggctgagtatcgtgaattaccacgcgtatttggtgcagtccgtaaacatgttcaaaacggtaaacgtgtaaaggattttaaaatctctccaacatttatcttaggcacaggtcacgtaacattcttttacgacaaactcgaatttttacgtttacgacaaatcgagctaatcgctgaatgtttgaaacgtggtttcaaaatcaaggacacgactgtccaggatatttccgacatccctgccgaatttcgtaataattatgtcccgtccgaagcgtccattgcgataagtcaagcacgcttagatgaaaaaattgctcaacgtccgacttggtacaaatactatggtaaatcaatttactaaggaaaaatgaaaatgtatcaagaatttatcattgaagcagatgccaaaggtcctaaatttaaagttaaagctttcattggtgatgcggaagactttggctcattaaaacgtaatgggtattctttcttaggtggcgatggtaaagaaatcaacacctatgcaaaacgtagtgaaattgcttatgttgtagcaagtcctaaagtagatgttgacgatattggatatgattttaacaacttcggaattatttctggcggtaaagcttaaattgtttacgcttaagtattaatatggtataattactctatcaaaacaaacaaggaaacaaaaatgaaaacgtataaagaatttattgcagaatccgccaaccaacgcgttgaaggtggttatatttggattgaacaagttgagccaccgagccgcacttctacaggtaaatggaaaattactgttgacggtcctggtggtaaacgtaggactcttaaagaaattaatgggtactatgaagaagctctttcggatgcaggaacttacatgatgcaaatcatgattaaaaaccctgaaaaccgttttgcagctaaagtcttccgtcgtattggtaataaactttatgatgcatactctaaaaacttccctaaagaataacataaattaaaacaataggaacaaaatgaaaacatatcaggagtttatcactgaagttacattatctgcggaacagaaagctgctatcgaagaaggtaaaaatcccaaagtaacatataaagtaaatagtaaaggtgtttttgatagcttggttcaagaccctgaattgaaaaaagctctttctaaaactaatgcgtactttgctcctaaatttaacacagccggtgtacttattggattggatgtattcaactctaaaggtgttctatctaatgcttttggttatgccgctaacaaaattaccaaagccgcatgggaatccaataccaaacaagctcaaaagcctagagtataattcttgcctaataaagggaaacgcaacctctcctcatgaacgtcgagtcctctgagtgatgtaccttttccaacctgtaataaggtcgagcgcaatgcggtaatgggtttacatagcgagtcgaaggacctaacatgtgccacggaatggccccaaccttaagagaaataatatgagaacatttttaactggaccttatctatccctgatgaatgcttttacacaccattctgatgctagagtagaagaaatttgtaagaacggttatgtcccaccatttgaagacgtactcaagcagtactgtacacttcgtttagacggcggccgacaatcaggtaaatcaattgctgtgactaactttgctgctaattggctgtatgatggcggaacagttattgttctttctaatacttcagcttatgctaaaatttctgctggcaacattgaaaaagaattttctcgttattctagcgatgatattcgattccgtttatttactgattctgttcgtagttttattggcaatgaaggttctaaattcagtggattaactctttctcgtattctgtatataattgacgagcctattaaagctcctgatatggataagatttacaatgtccatattaaaacagtacagtactgctgtaaaagcaaatattgcatcggcggtaatgctcgtcctcaattttttgtgattggaatgcaatgatgaccactattgaagtttttgaatattgttataacagcccagtatgcaataaaagggcccttgtagaaaattacgagatttaccattttaaacctaaacgataccttttgactaaaggtccgttcgcagggcagcaggttctttgtactgctcctaatgcacggttaatgactagtattccacatttcaaaatggaatttattgatgggccatttaagggattaatcactcaaagtttaatggcgtttaattccgacccatttttgattaaagaaaaaacttggataaatttattttctaattgaggttatatgaaagcatatcaaattcttgaaggcacacacaaaggcactatttattttgaagacggtactcaggcccggattattgtctctaagacttttaaagaagacgctattgtagacccggaaattttctacggtttgaatgcccgtgaaattgaaattgaacatcaacctaaagttaaaattgaaggtggtcaacacctgaacgttaatgttctgcgtcgtgaaactctggaagatgcagttaagcatccagaaaaatatccgcagttgaccatccgtgtatccggttatgcagttcgctttaactctctgactccggaacagcagcgtgacgttatcgctcgtacctttactgagagtctataatggctaaattgattatagaagggtctgaagatgttttaaaatgttttgccgcctggtttagttgctcaggcgagcaatcattcactgaagcatttagaatgggtgatattactggaaaatatccgacaaccgatatcactgtacgtggatatggtattaacgagcctatccaattggtcgaatatgaccttgccaccgatgaggaaattccttatgtcgattgaagacatcaaaggctacaagccgcataccgatgataaaatcggtaaagtgaacgctattaaagatgccgaagtccgtcttggattgttgtttgatgctctgattgaagaagcatatatcttgaaagaaaatgaaacagagcaacaaaccaaagaagatatggatgcagtgcaggctcttaagtatgctaagcaacatctaaaagaagccagcatgtgggcgtgtcgtgcagtatttcgtcctgaggaaaaatactaatggcttctactattactgggttattggactttcaagaaaaggtcaacaaaatttgtagtgaatacttaaagtatcttgaagaagaccttgaagattgtaaggaagaaggcgaagaagactatgctgatcagcgtcgacgccaaatcgaagagatgaggcgtttcgccaatatagtatctaaagaatcttggactttaactccattttatcaataaagtagtttacttctcctctagttgtgttaatatagacctgtcaactagaggagaaatcaaaatgactatcaattcagacgtttttatccgccgtaataaactccgtcgaatctttgaaacggagttccgcaaaataaatgccggtataaaagatgctgcaaagtctcttgggctaccaggctttcatatcaagtattctcaacatctcttagatcgtgccatccagagagaaatagatgagaattacgtttttgaattatttcataaagtaaaaaatcacgttaaagaagttgcagaatttttatcaatgccggcccgtccagatgttgatgaagattttgtcgaaggtgtcgaatatcgcccaggccgtttagaaataactgacggaaatctttggttaggacttacagtttgtcgcgaaaatccagcattcaaaatgaagactcttcaatgcagaatggctattattaacaataaacgactaccaggaaaagcttctaaagcagtgattaaaatctagaggtaaacatgagaaaagcactactcgctggtctatttgctctttcattatcagcacatagctccgagcatacttttagtaatgtccaactcgataacttgaattatgcttatcagtttggggaacagttttctaaggatggaaaatttaaaacgcatgaaaatatgcataagaaaggacttggatacataatggccgcaatactatggcaggaatcatctgccggtattaatcttaaagataagaaaggtcaccatgcgtatggaatgttccaaaattatctaccaacaatgagggcaagaattaaccagcttggttataatatgactgatgcccaaattaagaaaatgctatctaagcggtctaattcagccagatgggcttatatcgaattttcttattggttaaatatacataacggggatataagaaaagctatatcctcatataatgcgggatggaagacaagtgccggaagtaaatatgcttctgaagtcctagaaaaggctaattaccttaaatcaaataaactactggaaataaaagaatgaccaaaatgttggctttaatagttggcttggtttcatttaacgctcttgctaatactacatatactgatgtaacggagtatacaaacagaacggcgtctgattactgtggtaaaagtcaagagtgtaaagtagatttttcacaaaaattgttatatgcgtataaagatggagaaaaagacggggcgtctagtaggttcaaggcgtctaccttaattaaaagatactataaaaaatggcaaatattagaatgctcggtggcggaacctaaagataaggcagcatgcaattctatggtggaccgtctagttgactcttataatagaggacttgcagcaagtgattaaaaactatatcaagggcgatattgtcgccctgttttctaaaggtaataatattgctcatgggtgtaattgttttcatacaatgggcgccggtgtagcaggccaattagcaaaggcttatccaaaaattttagaagccgataaacttcaaaccgaattcggagacaagtctaaactcgggacttattcggcttatgaaaaatattttaagacccataaagcttattgctttaatctttatacacagtttgagccgggacctaattttgagtactctgctttaatgaattgtataatagaattaaatgaattcggaaagaataagataataaagcctgtaatttatatgccaagaattggtgcaggtattggtggtggaaactgggatatcatcgaagagattttagatacgtattctactaaactagaaattgtgattgttgattgggaaccgttattatgaatatacattatccacatccatacgatccaaagaataaggcagtaattattcgtcaatgggaacgcatttgtcgtactaaatgtccaattaatagtccacatgatgtagataaagactacatcggaacattcgttgaatatacctttattgataagaaaggccgtaaacaacatgtagaagaatattgcttaaaggtgacatggctatgagtcaaacaaaaattcttacaggtgctaaatgcgaaaaatgcgaatggcctgtagtttttgctttatgcaatgacgaaatggcttgtgattttgattattggtgttactgttcgaacaaaggttgtagcaatcataaaggtgaagggttttactcaggattttacccttacccagatttcgttaaagaaggtgaacctaaatgaaattgactaaagaagagaaaactaaactgttcgaacttatccatgacctattggatgagcaagcagccaccaatgcgtacgatgaatatgctcctttgacggacgaagaatatcaagcattgttggaatcatttgacaggaaagaacaagaactcattgactacgtgaattcactataagggactcttatggctagtttaatttttacatatgccgctatgaacgctggtaagtctgcttcattacttactgccgcacataactataaagaacgtggcatgggtgtattagttcttaaaccggctattgatactcgtgattcaaaaggtgaaatagtctctcgtattggtattcgtcaggacgccaatataattacaaaagacatggatatctttgaattctataaatgggctgcagcacaaaaggatattcactgtgtatttgttgacgaagctcagttcttaactactgaaaaggtgtatcaacttagtcgtattgttgacgtatacaatgtgccggtaatggcatatggactacgaacagattttaaaggtaatctatttgaaggttctcaagcattaatggctattgccgataagcttgttgaacttaaaggtgtctgtcattgtggtaaaaaggccacaatggtagctagagtcacggaagacggacttccaattacagatggcagtcaaattgaaattggtgataccgatagatacgtgtcattatgccggaagcattggaacgatttgacagggttgttataaatactaatatctaaccaagaggtatatatgcagcaattaaacgaaagacaacttcgtaatcttactgtaacccaattggatgaaatccgaagagaattaggacattctatttctcatttaaacgaggatatccgtcaaactggttctaaagctgattatacacgcaagcgcaagctggaaaaatacctcgcagatgttaaggccgtccaaaggcgaaaaataaatactggccaaaattaacaggaggcctatatggccttaagagcgatagctgtcatagcgatgctggggttttttgcagcaacaactcctatcgttggtactgcacatatcgacccatattttgataactttatggaatcagggattaaaaacgtatatactttgtttgaaattcaaaatgtcgagaattctgaaaaattctataagtatatggcaaagcattacaaaaatagtccctgtgatgatgcatttgaatgtcatgaacaaggcataaaaactgccagacaatttgccgagttcatgaaaataaaattagagcctacatctatctaatttactagccccttccttatggttggggctttttggcatctatcagtttacttctcctcaggttgtgttatagtagtccttacttactagaggagaacgttatgtcacgtaaagaaaaaatttctaagttaatgtttttgattgaagagtacgctaatgcggtatctgattgggaaaatgctcatggttgtgaagatggagacatcgacattaacagagctatgaaaaagatggctgacgcccactccgaattgcaaatgtatgttaacgagattatgtgaggatattatgctttacgattatactggaaaatctgaagacggtgtacttgaacttttacctgaaagcgctgaagatgatgatatggtggtgatgttttgtaaaaatggccctggggataagggatggatttatcttcgtcaagaaaatgacttaattgttttggaccctaaacaagttgaagaactttatcaacatttaaaacacaatcggtagtttacatcttggtaggactatgt

SEQ ID NO: 8 - DNA, 168616 bp, artificial sequence
  BP1002
ttaggccgcaagggccttcatagttttagcgatttgagaaacttcatcatcacttaaagagttgcgataaccgatgaagtcggaaacaatgcggaatttcttggtaaactcagcaaccattttatcactgttttttgaagcattatttgataatacatcaaaaagattagttactgtccagatgtcatgaccaatggtatcttttccaccattgaaatatacgccccgtaatgaactaactatattagcgagtcgtgtatattcttcagaaacttcatctgtactgaagtacttcatcataaaatctagttcaggatacttgataattttatcaatatatcgttgagctgaacttgaataacctacgtacttatcataatctacatcatcaaaagcatctacatataaatcacgcaaagcttcaaaaatacattggcactgaccgagttcttttacctttttctgtaaaagcggacgaataacataaaattcattaatgccaataagattagccatacgaatcaaaatattcatagatggatgacaaagagatgtagtaccatccatagagaaaatatcagaacgatgcatatacgctacataaccagtaatttcatctgcttctgatgtgagcgtaaataattcctctttttcccagcgcccgtctttaatttcaaacttaaatgctgtagcagctttaggacgaggagctttacttttaactacctttggaatatagcttttaactaaagcttcgatttctgacaaataatgaatgttaacttcatcattttcaaacattgccataatatcagggagtaaatcaatctgtgattctacttccggattaataaacagaagacgctcattgtgatgaatatttaaagtgttattaaattcactatcatctaatgtacgtgctaatccacggacaatattaacacgatttttaatattatcaataacgatattaatttttgttgtattaataccaaacagacgataacttgatgcaacggctgaagtttcatgactttgcttaatgcgtttcagtcgagggtcaagatttacttcatacacaactcccgcgttacataacttactatcaggttcaaacatactctgcatcttcttatatgacagatttttagtcgtgaatttgactgaattactaatcatataatctcgagcagaataccccatcttcatcaattcacgatatgtgtgacgaggagatgtagattctttaaatcgttttacatcttcattaaatgctttctcactgagttctttaactcgttcaataatatttttacgagtgcgatcatccagtgaaagagcctcgcgagatggagcaatatcaagtgaacccattggaaacttaatgtaattcacttcattgcgaatgcttagccagttacggtctctaataacaccgtcgataggataaacaataccgccatagatagcatataatccaccgcgatcaggccagtatctttctggatttacgccataataatcatcaaaatccggaaaataatcaatttcgcggtcaaggccattaatgatagccaaatctttgaatggtcgcatgatataagaaacttcataagcaaagtttctaaagtctttttcttcaactggaactacgatttcaataccagttttatcatctggacccatttcttttacgaatgtaggtttaatctgtgggccatcaccatccatgtaagctacataaccacgaatttcacctttatgatacgaagtaatactaaacgtatcagtataactaaacggagatttagaacctaaaccaaatccgccaatgaaatcgttagattcagccttagatgaactgaagtatgaattatacagaccaggagaattatcatcaccctgaatatcaaaatcactcatacccggaccaaaatctcgacaaacaaatcgtggatctaaacgtccaggaacttgtatgataaatttttcaggatttccattgagagcatgagcatcaatcatgttagtaattaattcacggaccactgcgcgaatcttgtttgtatacaaatcagatgatagaattttaaatactttaggatttgctgcgatgctaaatgcttttgatttagaaccattgccaagaattgtttctttttcagtggtgataatcataatttcctcattaattcatattacgcttaataacttcagcaacttctagtagttcatctttagttgcggtatcggattgaattttatctctaatatccttaaagcggtttttaaattcttcggcttctcccatatcgaaaaagcgttgaatgattctatattctcgatgaactgctttatcaaaaagttctaaatttactttatatgatttcatttcaatatcctcatttgcccaattaattataccacatccttgtggtaaagtaaactactggctcatccattctttacgaaggtcagcgttatctcccatgagcatttcaaaaagctctttccagttctcaggaagtttaacaacatcatatactggattttgaatcatctcacgatattcagatttttccaaagagccaagtcctttaatataacggatgctatgtttaggtagagcatctttagcactctcatattcagcgactgtataaaaccattcttgttttttaccgacctgagcgataattacaggagttttgacaaagcgaattcttccttgctcaaacaattctggccaattactaaaaaatccaagcagagaaggataaatgcttcctagaccatcatggtcagcatcagtcataatagcaatattatgataattcaagttttcagctttttcaccgagaactaatccagtgattgcgcaaatatcaaacagttctttgtttttaagcatatcagcatatgacataccccaactgttgagaactttaccacgcaatggataaccaccatgaagttctttatcacgaacatcaataagatatccgatagcagaatcaccctcagtcaagaaaagagtagtatcagcatctttaccacaaagattcgctttgatatgtttatgaaccttagctttagaagcctttttagctgctttagtttctgctgctttttctgccgccaatttacgagccaaagcagcttcaataatcggcattagaattgcttcattatttagaatagcgcgtgaaatctttttagcatcaagttgaatatgactacgaatttcgccaaatggagaagtcaaacgctctttagtttgagaatcaaatcgcatgtttttcatatcacgaacaaacataacgatagtcaaacattctttaacacgcgctttagttacatcaattttgaacttacgtttgatttgtggaataaggtcttcacaaatatcatccataacacagtcaatgtgatggccaccattcttagtgtgaatgttattgacgtatgttaattgacgaaaaccatccggtgaacgaccaaccgcaatagaacaattttcttgttcttgaacgatagcatgctcatcatattggcgtgcatatttcttaaaattgccctgaacctttttaccattaaaggtaaattgaatatcaggataaactactgcaagtgtctggagacgatctagtgtaatgtcaagataaacttgggacagctcattagtttcaaatgacataaaatcaggaatgaaagtaacacgagttcctttccattttccaggaatagtttcccatgatttattttccatgccatttgaacaacgaactacaatattattttgaccatcaccagtttcaccgacaaacatcacagaaaaaatgtttgtcaaactagaaccaacaccattcataccgccagtgacgcgttctttatcatcaccgaagttaccacctgcttttggaatagtccatgcagcaacaggaccaggaatttcttcaccggtaggtgttttaaccatcgcctgcggaataccacgaccgttatcttcaactgttacttgattgtttttaatagtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagcagaagagccaatatacatgccactacgctttttgatatgctcaatatcgctcagaattttaatttcattcttaatcatcacttatcctcgtttggtttcgggaatattatactccggtaatcataaagctaaaggcccgaaggccttttatttaaaacgaatagttgaatccttaaagaacagcccagaacatactgttccttctactttctgcccggtaggtccaatagcacgaaatccagtatgctggaaatcattttcagagcaaccgaaccagttatatccagtgatttcaatattagtaaacccacttgaagacaaaactttggttgcattatcagcatcagtacatcctactaaagatactgctaatactaatgccgcgatagaacgattaacatatttcataattttcacttaaatttaatggcttgaagaagactaataactctcaagcgacttctttcatctttaactgtaaaagaaagagggtcaccagacttcatagtaatagtgcattcaaaatcaaaatcttcggaaacttctttgaagaagtcaaattcttcatcataaattaaaacttcactccgaagactgtgaagaatttttccgtcatttccagatgctgtactaatcattgtaacattattacctttcatatcttcaacgataaattcgcttgtagatattacagcattaatagaaccattcctataaatagcagaaaatagatatttcttttcttcaccttcgcgaatgcgatatttcttacctattttaaacataattaccctttaagtaagtcgtaaaatccgccattcacatgcttaggggcagagactaaccgaatagcaatccgatgacaatcaggacatacatcagtatctctttcagaaattttcttgattttttcgtattcttttgcgcagtcttttgattgacatttataatcataaagcggcataattattccttaaagtgagctttcaacatctgatacaaggaccatgcctgttcatcattttcaatagtaactttcattacagggaatttagattgatcagttatcggtgcagattcttcctgctcttcagctgcctggtatggattttcaacttcattaaagaattcagcttcattcgatgaaagccaaataaaatcttcatccaaaatatctttaccagaagatagtactaaatttccagcaaatgacataattttaataggacgcccaagagcatccacatctaaaattttaaaaggatgcatacctaaacggcgtgcatagattccgttatcagtatggtctttaataaaattttcttgagcttgtttatttttgaattgataccatttattaacttcaaatttaatagccattaataaatttccttccagtaagttgtgccatcttcagtaatttcacgaaatacaccataaattggctgtttatcaccgactttctcatacacataaacagaagtcaagtgagtaaacttgctagtatgttccttttgaactactaccaaatttggatcaaataatacatcttcaaattcatcattagtgcaattctgaacaattttacgtttcattacaatttcctcattaattaaacattggagcgatgcgtttcagaagagtatcagcacctttaacgaattatccattttattctccaagttgttttctgtatcagtagttgatattgatatagtaccataatcaactactgatgtatatagttttatgaaaaaattttaaactttatgcatagcgagctttgctgtagtgtttaatccaactttcaggaatgactttgtatgttcctaaaaataccgcgttgtataacttaacgccatcttcaatccactggtcagtaatgtatgcacacatagcgcgagtacgctgaggaagtggttgtccaccttcggtaaattcaaactcataaggagcaacgaacttgatagcttgaccgagtttccacttaaagtctacacctacatgcgaagtatcaatcgtttcaattcctttagcaggaacagctttcaaaaacgcaggctcaagaaatttccatcgaacataaccaaactggggcttagacattccatctttagcaatgatacgtacttttacttcagaatcttcatctttaacaccgtgtttaagctgaatgcttacaacttcgaccaattttcctgctgctttagaacgggatttatcagatacacgagcaatttcaccgatattaatattcataattatctctcacttgttaaaaagattttatactccacaggaccattatactctggtcccaagagtttgtaaactagcttacacgaacattaatcactgcgctacgaggaactacagagtattctccagcatgaactacgttcagaagttcaacgccatcttcaatccactggtcagttacccaaccaccgaccggattcgcgaatggacgacgaatgtaaaccgccttacacaacaaatcagtcgggtcttcaattttttcaactggtgccacatacatagaaactaaatccatatcaatatggaatttttcctgttcttctttttcaatttctgtcaatagactaaaatctttttcataaataataagcgatgacaccattccataatagtttctaatttcaatatacatcatgccgataagaattccgctattaacactaataacagtaaaaggatatccgccagttaaagcaagaagttcacaaaacttattatgagctgtattagacagtaccggaaaattcttaatttcatcaaattttttcaattgataaacagcattatttttaatcataattttctctttaatctaaggtaataaagccttttagttcagcatgcgatttgcggaacattacttggtgcccaccaatgataacttcatcttcaggaacttcgtatacagcgagataaaatcctttagaagataattcttcccgctcttctcgtgtgaaccatctcatcatatcatattcactagcgaaagcaaaatgataaagacctataaaccatcctggaatatgatattctactccaacataatctttcttgaacttagtattaattactatattagcgtttttaactaatagtttatcttcgtgtggtaaaggaattcttttattattatcgctatgatgcataaaattaggtctgtcataacctacgtgtaatagccactcttcgctacatgaatctattatactcctgtacggcgttatttgaacacaaagatttcgacgtattgttatagcatcttcataatcaagaatactaaacgatgattcaacacgataaattttcattttattatcctcagtagctatggtgttataataccacaactaaccgaggaagtaaacaactttttatcgttttgttggaagagatagaggatcgcaatcttcctctgacggagcatcttcaagacccatagcatatcgcaaagcatacttcatcatcagaatatctttcgcacagtcatgaatagaatcatgcgcaacgaatccatctaaagttccttttggaagaggacacgtggtcatatcacgaacaagcagaagtgcttcaattctggtacgaatatcacgctgattccagaatttacatggttctaacttaaatgtgtcaagctcattctcagaaacaccattaagacgttgaatatcacgaatgagatcgactaaaattggaaaatcaaacgacattccacggcaccagccctgagatttccaaggatcaatgttatgcgcattgatgtaatcattaaattttgcaataccatcgatagtgcttacatcttcatctgatggtgcaatatttttttcgagcttcaggagattggttcttccaccattcaatagtgcttttagtaaaaagacgatgtcctttttggctttttaaatcaaatttgattttaatgccacgtgaaactaattcatcgaatgtttcaacgacttctggattagggtcaaaagcaattacagctaaatcaataacagctgccttttcgccgcttcccattgtttcaaaatctataataaaatcaaacattaaattttccttgctaaatcgcgaatttgacctacagtataatcttgaatataaactttattaataggttcatcaataaattttgccatagattcaatatctttttgtatttcttcaagactgtatactatctttaaagctttttcgcgaatagtaatattttcaggaccctgattttcttcaatgacagctttaacatttgtcataagagatttaaactggtaccaactcaattcaatcattaataatcgccttataaagatagctaatttcgcctaaaatataatcattgattgtaacagttttcacttcaccacaaaagaattctaacgcaattaaatctcgttcaatttcttctaattgaagcctcaacttactagattctatttttacagtttcacgatttttgctataagcaatttcataaatttcgcttactttatcttgaagaagataaaactgatctttagttatttccacgaatagcttcctcaaatttaatcatacataaaacacatcataacgaccacgggtaacaccaacataaagaagttgttgagccaattcagcatctgcataatgaatacaaggcgtataaatgaaagcacggtctacagacataccttgagctttatggaatgttgatgcaggaagtgctttcactttactaaactgtgatttagcatcccaaaaatcactccatggagcttttccgcctttgttccaatttttataagtttctgccgttttacctaaaaataggttaaacttatataactcttcatcagatgaaattattttaatcttttcacgataatattcatcatcgccgtaagtttctactgttaaatcccaatgacgaattaagtattctccaggaacaccacgagctttaacaaacgtcgatgtatactctgcttctataatacgaactaattgtccgttattaaaaataatttctgacacaggctttccatcaattttatatgttttaattaatggttcctgcattacaataatttcaccgacaataaaatctttatcagtttcaaaaatctttttacgaataatgctatttaacttgtcaacagatttattcgtaaatgccattacgcgattttcaaacaaatcatctagagatttgacgattgaaaaataatttaccataaaatcgcgtaaagcggtatcaccagtaaatccacgtactccatgcccgtcaacaattttatcataaatccacttaccgttacgaacgtcagtagctacatcaataataggagcattactgcgtttaacttcagtgagttcacactgataaaaatctttgtgtgtaaagaatggactgatataagcagtgttttctcctgggtcaacaggtctaatctgcttattatcacctattccaattatagtacaccacggcgggatagttgaaagcagaattttaaatagctttctatcatacattgacacttcgtcgcagattaatactctgcatttagctaaatccggtacttctttttgttcaaaaagaacgttttcttcatatgttactgggttaattttaagaatgctatgaatagtacttgcttctttccccgacagttttgaaagaatctttttagccgcatgagtaggagctgctaaaataataccagtttcgcctgttgatattaaagcttcaatgatgaacttagtaagagtagtcttaccagtaccagcaggtccattaatagttacatgatgtttcttttctttaatagccctcataacgatgttaaaggcatttttctggccttcggtcaaatcatcaaatgtcatcgtaaattccctgcaattggtatactaacaatacgcccagtatctaaaattcgctgatataatctttgtgtgtctacgtcaggcttaacatgtttaacttctattttattaaaccaaaacttgcgtggagtctcaactaatcttggaattcccttacctaaagctaatcgatactgctctttaagagtagtaaatactttatcagcaatattccattcaaaaaatacagcaggacgatgttcatcaagcggaactggcgccgtaaatccgtctttgtctcggtaaactatcgcatatacataaaccatattatcctcggataagtttaaaaattgaacaatttagcggatatcctcttttcagtttaagtttatcaataaaagacaagttttgataccgctctacaccttgaataattttatcacacatatcatattgcatttctgcttctgacaactttttcacaattttccaatccgagcctttaagaagaacgttcaatttaacagcttcagcgccttctgctatgcgagaaccatcaatacgagctttaagtgctataatccttagcttaatgtcagaggtctgttttgatttagaaagctgagaaatgtgttcaattcggttttcacgttttttctgtatagctttaatttgattataagtctttttgattttagcccatttcttttcatctaaatttagtttatgaacttttttcgcagatgaacgaccaattcgcaaagcaaataaatcacgcttttcaatcaactcttctaaagtataatcagaacgaaatgtattatactttttctttactgcaataacattccctttaatgtatccaacgttattatcaaaacgttctaatgataatttctctccttcaacacgattatcaaaaggttctcctgagtaagcacaaactttctgatctaaaatgttcttaatgtaattgaagtctaagttaaaatctttagaacgtctttttgcagatgcctgagtatgctctagacgacgtttaattttacgaatttgattattagacagcttcatatttttctcacatcttacggacgattaactacttatactataacatttttactttaacttgtaaacaactttatgaaaaatgctttaaaactttcatggtataatgaatctaagtccttccattatagattaaatccttcaaaatcaagagtatagatagtatatgttgaatactttttgtactcatatctatctgcaattctaaatacacttccagctggtatcattacttcttgttcatctgaaactaattccatattacgataacgatgactatccggaaacttaaagtttggattgtattctttacagcgtagagcttttatagcatactcctggaaattgaataccataggagctttgaattcaaaaataacttgtgtgttatactctaaaccggaagcaaaatgtagagctatatttttatcatatgaagctgatacgactttatcaaatgtaataatatcaattccttgatttaatacttgcttagtctcagctggaacacctctccaaagaggtttatcgtttggttccaaacgagatttgattatttcatttaaccaagtatggtcatctggtttattagtaatacaatgaattaaaagttcaatttcagataaattaaacccttcagaaagtaattcttcacgaatagaagcacgcaccgatgcatccattgattttattttaaaatcttttagttgcattactgagtatttcattcaaccacctcaatatcataaactttaaatgttccaaatgaatcgtgtaatttttcttttgaaatagaagttattctatactttccaattggaatcatccattcttgttcacgcacaatcatcattaagttatcagtacgctctgaatctagcccatcagtatcttcatacgtgtacttaaactcagtattaggagaagaaagtataatatcgctgatatggtcagaataattaaaagctttatcagtttttaagcgaaatattatttcagtgaaatactcaacataagaaaaaccacatgctgtgtgcaaactagtagtaaatgaatctaccctattcgttgaaaacacttctccaacttgtaaatctttaatgagttcttttgtcgattttgatataccacgatataactgataaggtgatttagttaaatgctttttaacgattttattcaactgccgatgaagagcttcattctttttagcttccatacattgccaaagaattgactgctcaaagtcagtaaatttttcacagacttttttatacatatcatattgaaaatcaacgctttcagcttttatagataactgttcaacatctgcaagattaataatcatgatagcctccgtatacttcagaagctatcatatcatcgatagaaaggaaagtaaacaactttttgaattattttgcccagggagcccagggcggagggtcaagatggtatgaagctagttcttctagaagagcatctggggcttcaattccataattctgtaatactatacggtactctttcttataatcactagaatcattctggatattcgtagaatgattatcttctaacatctcaaataaatccatattaattcctagcgataaaaaccaaaatgacgattagtttcaatgatctttctttcttcttcggacattctccagcgtagtccaacatcaaaatgagcccagaccatcctaacaaatgcatttatatctttaatatcttcaataatgaatgttttacttttagaaggttgactcgctaatttaactttatcatcttcaaacatgtcaaaaagaccatattcatgagctcttttatagcctttaatagttaaagcttcagaagaagaaaatggtgaatctgtattctgcaaaatatcttcagtatgctttataattagaataatattttctggatattttctttcttttatatctttaattaaaaaatccggattttctgctaaaggaataattaatgagcattttttatcaagtgtatttactgatttaccttctttagacataaattctattgaataatgttttgctacttcaatcatgtgatttccttttgcctactaatggaccatcgggaattttgttttcctggatatatttctcattttcttccatcattttactgccaattttaagaagcaaatccagtgcttcatttgcttttgctttagcctcttccaatgtcatatctttgttcatgatttatcaccatagatgtctctcatcaatttaagcgctgagcgttctaatttcttttctttctcagcactaatcattgatttcatccattcttccgattcgttctgcatttctttatttgcttgttcaacccaaccatcgtcaatatacatcgagtttggtctattgaaccattcaagaatcttcttgagagctttcatttattttacctaaaacaatagtaggagcatcgtcaaatttatgaatttttagtaaatttggatttaacttattccataaagaggtaataaaatatgatagcgcactttcgtccgtaattataaatttatttcctttatctattttccaatcatatattgaatcatatgaatagaaggataacggtttattattataatatgcttcactaacatcaatatagttagatttagtaaatgcttgaattgccataaatggagaattttgtacagtttcaataattccgatctttttaagttttatttcaacatcttctggaatttgcattgaaataaaatcttctactagatacatgttattgtcatatcttttatcaatcattactgctacggtaattggaacatccttgacaaacgccatactaatactattgatagacatttcaaacaaaattgcttccataattttcctcaatcacaagatgtagatgaacaactagaatcacaagaacttccacatgaatcgcccgtccatacatgaacaggaacatttgtatcatatgaatcagaactagactgtgttttctgtgcattagatgatgtagtaggtgttgaccagcgccaaggatttttataatattcttgggcttcttcataagtcatagtaactgcttctactgttccatctcccatataaacatactcaactacagttaaaggaaggtagtcatttgaaataggaactacaccttctccaggagtcgtagagaaaaaatctgtaaagaaatttttaaaccaattaaagataaacattacaaaaagcctctttgaaattcgactctttgaaatccaccccagtcagtgtatcgcatttcagcattgaactcgactgaaccatctgcatgcatcatgaatgaatgcgtgacgatatcacaatcccagcttttcataccccatttatcagagatagctttatcaagaaccttctggaggtcttcatttggtttaatccaacgatttaacatggtgttctcctctataagatatttttattataccatactcattttggaaagtaaaccgtttaaatgaaaaaaggactcccgaaggagtccttgaattattaaccaccagttactttccacaaatcttcgtttgcagcaatccattcagtacgctgattttcttcatatacagtagtatatgctgctttttctgaagggaacgtctggtaatgagcaccagaaattttgtgaacgtcagaataaagagggaaagctactgaaatttcctttccttcaattttcttatttccatctaatttctgctcaaatgttttgatattaacataaccgcgagtactagccatgtaattctccttttatttaaattacatgattatttatacatcttcttttctgaataagtaaattaaattcttaagagctgaacttgttacatcatattttcctttaagcgcctttacaaccgggcctgttgctggtttacctaaagaaacccataactcatgtatttcgcttttaagcggttcatgccaatgcggcgcttttctttgcgcccttgaagttccttctgaaatctttttatttccgccattcgaataaaactttttcattacttcagattgccgagcttttcgttctgctctattttgggctatacgttgtgaattcttcatccgagtttttgtttcaggattgtttaatctaagtttatgttctaatcgttgttgctcagtccattttcttccttctccaccctgaccaccaggagaaatattaatgcaagtatctgggtgtttacgttttaatgcagatattagctcgcgttcaacttcatatgatttttctctagaaccatggcattttgaccaacgtattttataattaaaaccatacttacgatatatgttccatagtattttgcctgaccccggatatttatcatcatatggatttacaataaatgattcatgtttcccagcgtaccaaaagacgcctttcggcgtcctaacttttacgatatatgttctataaaatttttgtttaatacccattatcttgacgttcaaaattatgtttatttttcaaataataaagtttaaagatttcttccgcattcattccaaggccagcaaacatatttaatacgaaatgaaatatatccacaagctcaaatttaatttcgagctgatcttctggggacatttcatcaatgcgtttttcttgcgcttcaatataacgtgctttccattttttccaaactgccgatgcatctttttcaccacgtgacatttcaccaagagaagtcagaagttcgcggaattcatcatcaatacagtctttttgttcacgcatccaagaaacaacatcaccggcagtttctaatttatctggatgataacagtattcgcggtcatttgctaaacgaacctgcaaagatttctgcatatcaagcataacctgcagcgggtctttttcatcaccaagaatatcccagtattcattttgagctttatcagcgccttcgatcagttgactacattcgttaaagtaagccattatttttcctttcaattcattaataagttaaataattatatcatttgattatgcaagcaattaattaaaaatatatacttcatcagttccattcttttctttggaatgatatatgttaaagacgtattttttattaagatgcttaacattatattttttagaccattctttaagaagagtgttttcctttccgtgatgctctaaaacattcgacagtccaaattttattcctctgtcatttaaagaatctaaaagatttaaaaggtctttttcttcttcttctgaccaaaatttattataatcagcaactgttataagatatggagggtccacatatacaaaatcgccgtctagaattttgacatctttaaaatgcaatgaactaaagattattttatcacaattttgcttaaagtgattaaagcgtttttcactatttttgtttatagttctttttccaaacggagtagtaaaatttcctttatcgtttatacgaatcatattactaaatccgtgaaaatgaagaacataaagtaaaagaggatctctagttttattataatcttcacgtaatttcaaaaactcttcttttgatgtttttgatagtttatattgctttattacttttaatacgtcatcccatgatacattaataagacgcttatacatttcaataattggttcttgaatatcattggccaatacaggaccattgacgttcaaagacactgataaacctccacaaaataaatccacgaatctgtcatattttggaaaatgaggcttaagttcaggtaataatgactgtttattacctgtatacgcgatagctcctagcattatattctctcatttattgcagcaaaaaacgaattatataattcttcatcatatgtatttgatagtaatactaacacgttttgtgatttagcatattcattaaaccttgcttggatggttggattatcagtaaatgattctctttttgtccatttattacgtggataatatccgcatggcaaaaaatctaatatcatcaatgacacagggttttcagtttttgtgtattcttttaatttctctttatcttctaaatatattccaaccgaatcaatagctgtacctccaccaacttggtgtttaatttcaattatatgctttttaccgttgcgagaaataacaatatcaaatcttctagtacgcttcttagttataaaattagaacaaaacaaattatttgatttttcagtatcatcggttaaaaccattttttcttgataactaactgaacaatcagtgaaatattcttttactttattaagtatgaaattttcaactacggcagatattttatatgaatctccgtttaaagccatttcatgtacaattttattaatcattatatcatcctcagcaatttattttataataccataacaagctgagaaagtaaacaaatttatgaaatttgtgataaatattaatttaaaggaggacacatggcacaaaaattaatggcacttgttgatgccataaaaggtaataaaaaacgtatagcttttactatttctgctatggtaggaattttactctggaactttattttatcacccattgcaattgcacatggtattaatattccagtagttactcttgatacattcgtagatttagcatttgctttagttgggttaatttaaatcttagcatatttagataaccgcattttagccattaacccctgggcaatattatttttcatatattccataatttgttcaggggttgcaccttcctttctaatcatatcattaacatcttttgatttccagggagatttatcccaaaacataaccctttctcctgcatcaactaatttagtcattcgcttaatagtgtcaggatgacgaggttcattatctaaaacccacacgcgtctatctttaaatggaacaacttctaggtctaattgaccacccgtaatagctataccattttcaataaaaagcgaatctataggtccttctagaacatatacatcaccatctttaactcgttcgactccatagatttttgttgcctcaggataagctttaatggtgatatatttttgaggagcatctttctttaatgcacgtccttgaaaagactcagcttttccattagcattataaattggaataacaagacgaggctcagaaatttcctttttgtatgttcccggtgctatgctattaactaatttaggccattcagttgtaaaccaaagatatttccatttatcctttggaatacaacgagcttttacgtattttataattggatggtcttccgccagtttatctaatctaacgcatgacggaagagatttaattattttcttctcaggttgtttaggaagttctttaggtttttctactggacgacttttacctttttcttttcttatttcaaagatatactcacgatataaatcaggttcaaactcctttagatatattccgattggtgcatgatagttacagttataacaatgaatatttccttcattattatcaccataataccatccacgagctttattctggtcggtttttgaatctccacaaacagggcatctaaaccgcaatttaaaagttgaactattatttacttgtgtgaatttaggtaaatgagctaatgcacgatacgcaaactcattatcaatccaaggtattgatgacattttttactcttctttttctttagattcctcttttttctttttaggaatctgttcaggacctttatttactacagcacctgacgttgttccagtagagatattttcaggattaccacctgaatctccagcgaccatatcttctttaataaattctttatatgttttcatattaacctctattcataaaagcattaaaaatttggtcatcaatagatggcgcagtaatattttctgcatcatttagcaaatcattaatttcatcagatagcataacacatgtacctttatttcctgtaattgttactgcgcaattacgaacgttttctttattaaattttaggttaatattttcgtaatgaaaatcctttaatgctgaatatatttttaaaataaaattgtcttttactacaataaacccaacctcactattaaaacgtggttcatggaaactgtaataaaccttttcatctataaaatcgtatgaaattttttccatttttaaatatgaaaattcagaactatacatactaacctctaattactcacctaccacttcagcgatgatatttttgttattaaagtttttatcgcaatacagaacataattatactgcattacaccaccagacttaagctgtttttgcacttcggctttcatttcaggacgatcgcgctcaacgatattcataatatctgcttcaatttgagtttcaacctcagtctgatcagcagtcatagaccattcgcacaaatctttatcataacctgccatagcaggctgagcagcacaagaagataaagcaaaaattgtagcaaagataaattttttcatgataatctcctcaatagtttatgtttatatagtatctcaatttccaacaaaagtaaacagttattttaaaacttctgcgtaatcacatgttacaaactgtttctctagcttaacgatcttacgaaaataccttttacactgacgaatctgccgcttcgtagggcgaacagcaaacttaataaattccactcgaccaaatggaggactttcttctgctggaatatctaacaccaattcccacgtatcggcaataagtgctttgaattgcgtatttttcctgacgttatacggagtaggtttaaataaaacaatatgcatattatcctcggcaatccacttcacatactttcttgtcatcaatgaaagctttaactaatgctttattaacttcagcatattgagtagtagcccattgaacgtcatctttcatcattgtgatttctttagtaaacatgctttcattcttaaaccaccccataaaaactacctttaccaattccataacaatctcctcatttaaccaacaagactactataccatagtcttgtcagcttgtaaactaaaattttaattcatttgccaaagcatctaactgtgctcgagtggattcatttctttgatagcgattctgctcagcctgaatctgttgtgaacctgctacttcactcacttcagttggagtagaatcttgttcaatttctacccatttttggtttcctttttgaacacccatcaaaaacttattccatttgttcttatcgccatatcgtgatttgatttgcttaatgagttgttgttcagcagctgctagctcctcggtttcaatgaccgcaagcataaaatcagctgttgctggaagaccggcagattctgcaatatcgctcatgttaacatcagaagaatcccaagcctgtttaccaacctgtgctgcagtccaaagaacagtttcggtttcaacagcaagagcacgcaattcctctgcaatagctttaacagttgtgtaactattttctgaataaactctgatgcgacaagatttacaaatacctagatagtcgacaataatgattgttggaacaaaattcttcttgagctttaattcatttaaaagtgatcgaaatgtattagcgtctgctccaccagtaggatattgcttaacgattaaacgaccaagggtagatttctcacgccatttttccatttttcctttatactcagcgtaagaaatatgtccatcatcaatatcgtcaagagaaacatcgagcatgttagcatcaatacgtttagcacagacttcttctgccatttccatggagatataaagaacgttatgaccaagctgcaaataatctgctgctaatgaacacagacctaatgacttaccaacgttaacgccagccattaaaacgttcagtgttccagtctcagctccgcctttagtaattttgtttagaattctgagtttaaatggaaccttacgagctttattcatataagatagccaacgtgcttcgtagtcatccatccaatcatgaccaacgtagctatcaaatgaaattgataatgcttggcgcatgatgtcaggaatagcacctacatctggcattttcttatttcgtttttccggaggaagctcagcattagtttgaatttcgattattttagacgtagcattaaacatcgccctttgctgaacatatttttctgtttcttttattaaccaactgtggtcttccggagaatcagccagttttgaaataagtgtttttacaccagaatattctgtttcagtaaatgaactattttctaatgcaacatttaacgcattaatagatggaacgctatgatactcattgacatgagatttaattaatttgaatgtatttttagctggaccactttcaaaatattctgaatccatatatggccaaacttttgaaaaataagcttgatcaaatatgagatgagaaagaataatttctaccacacttactccttaaaagaatttaaattttttctttgaccttttattaaatgcatcttgtagttgcattgtaatacatttttctacatgaggagctaactcagcttttctttcttggtcaagaacagcaaagtccattacaacctttccatcaacccaatccagtttagttacatacactatatgtgtagaaccatcttctagtttaatgacaatctcctggataacattttccatagcagatttaattatcttaagagactcattaaaaagacgttcttttctttcttcttccccctccgaagagggggattcatcgataatttctagatctaaatctaaatcatctttattcattaaattcttccatatcacttaactgttcgaggtcagtttctaaatcagcagctgatttacttttactttctggagatttaaatttttcaacctttgagttaatcaattcatcaacttcagcttcaacaatttcattactatcaatagcacctaactgataagcacgtttaatagcatctcggaatggttgatgcttaaataaaggaccccagaatgtagtgcagttggtatcttttgcacgccaagatttttcttcgcgaatcatctcgccggtttcttcgtcaagaaattcacgagcataccaaccatttttaggttttactacaaatcctaattctagagccatatctaacaatccagaataaggatcgataccaccgtcaaatttaacatcaataaagaatttacttttttctttaacggtacgagatttttctacatttagaacaaattgatacccctgaagatcagaaccatctttaatttgacgtttaccgataatgaatacagtatcagccgaatacattacgcctgtaccgcctgtcatcacggttttactaaacatttcaattgtttcaattgtatggttaaccgcaacgcacggaatatttttaatgctaaagtaaggagtaacaatacggaataatgacttcagtgatttagcacgagtcatatctgccacagatttttcattcaaggcatcttccgtttctttcttggaagccatattaccaattgagtcgatgaatacaataaccttttcaccacgctcaatagcttcaagctggttcaccatatcaattttcagttgttcaactgactgaatcggcgtatgaattactcgttccgggtcaactcccatggatcgcaaataagctggagtaataccaaattcgctatcatagaatagacaaaccgcgtcaggatatttgttcaaatatgccgcaaccatagtcaaagacatatttgatttaaagtgtttagaaggccctgcgaaaatagttaaaccagactgcataccgccatcaatcgcaccagaaatagcaatattaagcattggaatttttgtacggattacatccttttcattaaagaatttagatgtagtcagttcagcagtcattttagaagtggaagctttaatcaaacgggattttaaatctgcaatagacattcatttttttccataggcatcattatattttcctcactggttaaagatagagtaattataacacaataaatttaggcattaatcaactgctattggatgaatagcattaaacttatgaaatgcttctgatttttctttacgtgaaacgcacatgcgaagaacctttaatggctcgtcttcttcacccaacgattttcgtttttcgatattagaagttttccaacgagcttgctctggaaactctctattgatttactcaagcgctctattatgtttagaattactacgaattgaactgcacccgccaggagcttgtgcttttccagatacaaccagatatttgaacaaggccaaatgcggataaccttgattaattaaattgagaaatgcatacatatcttcgcataaatcaatttttccatacccaatttgttctgtcgtaagttttccgaggtcataccatgtatttgtgaatccatatgaattttcacgataattaccccaagatgaagtaattttaaaaattggtagacgagcatggccatgataatatccgcaatccatggcatcctcaacatattgaatcaattcatagaactgttcacgagttaattgattaattttatctacacatcggcgatcatctctttttcgcattgaactcatacgaatagtagtatcatcgtcaatcatccagattcgttgacctgcatacatatcagtaattgctttacgagtaccggcaattccgtttacatcatcaggaatagttataattttagctctagacccataggcatcataataagctttttcttcgtgttcacgcactacaatatggggttcataatcagttggaaacatatcaagggcagaaactgccccgacacgttgataacttggaattacgaattgaatcatttccactcaccgttataatcttttttcataatatgagtctcaccggtgttccaccaatggtcaactaaataaaactgattttcgtacacatgaagacttccaacgttccatataatagaacctgctttatattgccgcgatgggtcgcctgcattcaaatcagatactaatttatctagtacgtatttttgccaagcataatcattacgatagcctgcccagcaatcattgcttctcatgctaacaaccgcattgactttcttatcacgaatcaggtactgtactgtattagtacacatgaaatctgacataccatctttattgtagtcaaattgcatggatggacgagtataaatcatgataccacgtcgagaatcaggattttgaccaagttcagctaaacacatatcatactgggcatagttatcttctgaccaaatagcccaaccataattcgagttaatttcacctttagaagatgctacctgctgccaaattttcggtgtttcacctggaatatctttaacaaacaagcttttagatttataccattcaagttcacgctgaatgtattcatcattaagagcgccaaaaataaacggttcatctgctacaaatgatgcgccaataatttcaatagttttaacgccagttttatcaactacgaaatctttttcttttaatgcagttcccaaataaaaacggatttcttcaactgtcatagagtcattaatcatttaaacctcaattgatgcattcatatttaaattgtaacagtaataaaccccaccctatgataagagttggaatcatagcaggaactgttacgctatagtatatacttattataatcatcaagattaaaagcaacactgttataattttgcttttcattccttctctctgatgataattacctgatttggttgtgcagactttttagtttcacccgcaattgaccaaataaatgtaataaaccaaccaataattgaccagttaaacagtaaagatgtgaaaaagattcctactgtcgattttgacccacgcatcaaagcaataaaccatggaagcatgtatataataatagccaacacacctgaaactaaaaccataaaaattgaacctgccactaaagtttccatattttcctcacttagtcaaattttttacgcatgaattataagaattcactacatactccatcggagcatttttaccagtacgccattggtaattattagcccaattagcccaaagctcggcgcagtagttttcaattttttcttcgcgtgtaattacatctgaattacgatatgcttgagcagattcatctggacgaatagcttcatcaaaattcgcctgcatttgttctactgtttgctttggagcttctttataacacttgacattaggattataaaatttgcttgaacagtttacaatttttcctgcatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacggtgctagattcaatcacaggttgagtatcattttcaacactaacaaatggaactgctgctaatgcaactaaacaaactgctaagcatcccataacaattttcattttattctccaaatccgtattagttgatagttgtatagtaccatggaagaacagtcttgtaaacagttttgtgaaaattttttagggaattctaaaggtccagaaccatctgtttttcataagtatagatttatattacttgtatgaaaaagggacccggaggtccctagatttattctatcagccaaacaggaagtctaacgaagctttttcttcatagtccataccagccgattcacacatacccgcaagcggtttaacaaacgatttttggaacaaagttgagtagtcaatccaagacagtacgtcagaacgaatttcttttggaagttctgtacccgacggccaagcaatgcatttgtcaccaaatggatttccttcacgcaatggaagaaccattactttatttccatccaaaattggagctacacctaaaccgctaacagctcgacgataagttagcacaccacgaatatggaacgggcatttaaatcctggccaacctttatcatcatatttcgctatatcgttcgcagtttttacttcagcaataactttatagtcaagttgacgatattctttctcgaagttcttgtagtattcttggacagactcttcaccttcttgaagaatacgacgaatactttcttcgagagcttcttgcactgcttttggtgttgaactctgctgagtttccatacccatgatttttagatgcggttcagcaaatcgtttatcttccatatcataaacgttcagagcataacgctttttcgctttccaaaatccaccaataccctttgaaccaagtggagggcaagaaatagcttcacggtccatatgcatcagatgctcgcggttattcatataatcacataactcacgatatgcaacatcaatcataggttccatctttttcttaccgaactgattcataaattcaaccaaatcgttctgctctttgaatcggtcaagaccaactttttcaataactttatctacacaaacatataccgaatcagtatcacctgctgcgatgaaatcttcaccattagttccgcatactttattcagatattcattaattttacgagcaatccactgaataccaacttggccgaaaattgtgatagcagtagcatttcgcaaatcatagtaacggaaatgaatattaccaagagcaccataaagactgttaataagaattttacggttcagctgatttgtgttagcaagtgtagccgctttttcacattcttcaatcaaactattgagaacagattcagtataattcgatagttcatttaagaaatcatcactgaacttaacatatcgttcaacttctggtttagttgaacaagaccctgcgcctttcataataatctttttaatagcttcggcattcatttcttcagcgaacattttctttttccaatctttacgctggaaaaatactttagcgatttcctttggaatgataccttcttgatgcttatcatacatccatccattcggagaacaagaatattcatcactcggtttaggagctgttcctgcgatatattcatgaattggatgaactttaaattgtccacgaatagtctcaggactaatgttaacctgacgaataatgctcggatacagagacgtcaagtcaaaactcataatatatcgacgagcaattggtttaggttcaaatacaaatgcacccggaaaactctgtttaacgtgcgaaccttgttgaggaataaccttatgttcacctttcaatgagttaaaaataatagcatcccaagttttaataggactcattacaccagaaaaaggcattttagcgtaataagacatacttaaaactagatcgataaacccgcgaattttatcaattgcttgaactgattctacgtcaatgatgttataactaatgtatcgctgatgattagtctcacgaagtttattaataggaccatcgtacggtaatttaccttttttggtttcatgttgagcaactgattccaaagagaatgacggcaaattagtaaatgcgaatttcttatacaaatctaaataatcaagaatagatacgccatcaatagaataaatttctttgctaccgtacatattttgaattagtttagattttacccgaccgattggagagaaacgtttcatactgcgttcaccgagaaccattttaacgcgattcatgatatacggaacgtcaaatccctcaatattccaaccagtaaaaatagcaggtcgtttctgttcccagagattaatatattccatgagcatatcacgctcattatcgaatggcatataaattactcggtcaagaatttcttgaggaacttcatcaccaccttcacagtcaagcttagcagctaactttgcatcccattttgatactgaaccgtacattgaattcaaaaggtcgaaaacataaaaacgatcgtcaattgaatcataatgagtgatagcatcaatttcatattcagctttcattgggtcagaaaatttatcaccagtaacctcaatgtcacagttagctacacgaacaaattttcggtcataaacaatttctgaaccatacgtatcactgatataagcgagtttaaaatcgttcataccaagagcttcgagaccgatgtcttccattcgcttcatccaatctcgagcatctttcattgattgaaatttttgaggagcgcaatttttaccataaatgtctttgtactttgactcttccttacaatgcctaaacatagttggaagatattctacttcacgagtacgttcctttccgttttcatcaatataacgttcaacaatgttatttccgactgtttcgatagagatataaaattctttcatagatattccttagtttatagcccgagttattaggctcttgatatattatactccaattaaggggccgaagccccttgcttaaattagtactatttgtcgggtgaaaattgtcaatccatctgcattaattgacttaacgaccgcggtaaagtgtttttgttctgggcgaactaatttttgaaattctacctgaaattttagttgaaggttttctggtaaatcgaaaagtgtttctgttgcagaaagattatatttttctttaagagacgccatgtattcttgcggagttatagcagtcatattaattaccaatcgtatatttaggaacgagtttccattcatgtttttgtttaaaagaaataactcggaagttattagttaaatctttcataaaagttctttgaccaggaacgatttcaatcagtccccaatcttctaatagccatgcaatcgaatcacgacgaacttcatcttcttctgtcatttcaacctggcgaccatccatacgaagcatttctttaaaatgaacgatatagtatagtccttttttctgaagaatatgacaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaaaccttttagttcttttaatactaaaggaagttttccatttttagtaagaattgatttatagttaattgcatcatttgtattaacttgataccgcttagcaagtaacttaataatcaatacttcggtggaatcttcaaccagttttgcccatttaccatatcttttaccacgaggaactgcagccattagataattaaaatgagcttcatcacttaatccagaaccgattaaattcatagcatatacagctggcatgcactctggaaattgtgataatgcattttcaaccatgaattttgaataatctttttgagcaatagagcatttagttttattattgatagctccaattatttcaaaaaattcattttcggctttttctttaaaagaatcagcagcggattggacagctgtccaatcttttgaataccaagcaatctgatgctcgtttaattgaatatcatcttcaaataagctcatatcacttccactgcatttcgcacgctaattgaatgaaaagatatgctaaatgtaattccgtattagccgcaattccatgatactgattattttcgccaacaatttcgtacatacgaataatactctgtggagttacacgtgaatagatttcttcggcaagtttacccacgaaccacgaataatcagctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttacagatttcagtcaatcgacgaatcatctgcttcatcatttcaattttatcttcatcggtcggttgaccgaacgtaataactcggcagcgtgactgaagtggtttaataataccatcaatattattagcagtaataataatactacagtttgaactataagcttccataaaggaacgaagatgtcgctgagactctgctaatcctgagcggtcaaattcatcaataacgattactttttgacgaccatcaaatgaagcggcgctggcaaaattagtcaaaggaccgcgaacgaaatcaattttacaatctgatccattcacaaacatcatatcagcatttacatcatgacacaatgcttttgctacagttgttttacctgttcctggagaaggagaatgaagaataatatgtggaatcttacctttacttgtaatagatttaaaggtttctttatcaaaggcgggaagaatacattcatcgatagtagatggacgatatttctgttcaagaatgtgttctttttcatttacggtaatcataatttcctcattcaagttttagtgtaaattataaagggccgaagccctttattaaaaatcgtgggtagaatcagcttcaagagctactacataattcacatgttcaccttcaaatttagcagcgccttgtttaccttttgcccagagcagaagtttataatttcctggttgcattttcatatttgccatattgataatgaaattaaatgtattttcaccatcataatcaccaagagtcaaagaatatttaacacgggtcaaagcagaatcttctactttattaaaaccgttaattacgattttaccttcttttaccgtgatagcaattgtatcaatttgcagaccacgagatacacgcaacagttgttgaaggtcttcagctttaatttcagtaacaacagatgctaccgggaatggaattggtttattaggagcaactactgtactcggatcggctgctggccaaaaaattgttgagcgtgcatcagcaattttaatatttccatcttctgactgggaaatttctgcatcatcattaactagagacagaataccgagaaaaccgttcaaatcgtaaattgctacatcaaaatcaataacgtcagaaatatttgcttccgcataagttgtaccattaactgcgcgagtcataataaattgaccggatttaagcataataccagagttaatagtagcgaaatttttaagcagagcagtagtatctttagacagtttcatgtaatttccttcaattcaaatgagatttaattttataactaattaaataaagcaattaacgattaaaatcagctgcgattgtttcggcaacaatttgagcagcaacaatcagacgttcatctgcattgccgcaatattcatcttcaaggcgttcaccacatgaagtcataataaatttagcaccggcgtttagggattctgtagtatgtttgcgcattagttcaatccatttattacttacttcacgatcgatagcttcataatacgcatgacgagcaggtgcagatttaattttgttctgaataacttccattgcgttatcagaaagagacaaaacccatgctcgacgaattttattttggttttgtggatttgattcagaacgcacgtgttttggctgaatatcttttacatcaacagtataattcacagtaattttagtcataatacacctttagtcataataatcagtaacagtccaagcttcatttctattggacattatttttgtatattctgctttaaatgcattcctaagcatagattcagtaactatatgctcttcattggaaaaattatttctcagaatatatcgttttatttcaggaatagttaatagatgctgtccagttgaatattccatgtttttcctccatagagattatactctaataaattaaagcataatctcttataaattaaaccattacagtaaatcgaccaactttcttcatttgaagatgctgaccgtattcttgtgggtcatggtctttatgcgaaattataaaaacattagtgtttttcattgaatttataatattagctacacctttaataccttcggcatcaaatgacccatcaaacacttcatcgagtattaatgtactaatactaacaccagatacaatagaagcaatatcacgccaagtaaataaaagagcaatatcgattcgtgccttttcaccttcactaaatgaagcataactaaaatcttcgcgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcagtgctatttcatcagcatggtcaataaactcagaagatgctttttctatagccgctttaacctttttagctttatctactgctgcgatcagagattgctttttattgcgaatatcatttgccaacgactgttgggttttaatattatctcggtattcattaacaagaacttttaaattatcacgatgtgttgaaagctgttcaaacgaatgcgtacattcagaaactttatctttaattttagaaacaactttatcaccggaactcaattgtgacaaacaggttggacataatccaccttcgtgatacatattaatgactttattatacgagtcaatttttgatttaattaaaactgcttcttgaccgattttattaaatgcatcagtcgggtcttcatctaaaacaatattaactaatctttcattagcttcttctatttccgattttagcgttctagcttcttttgccaaatcatcatacatattttgaagacgtgtaagattgtcacctgttaattttttctggcgttcaacgttatcattatatattttaatttgttggataatactatcttttttaacgtcaagcacttggttttgtgaatttaattcacgtattagtgctttattaagcttatccatttcagctaatgttcctacctcaagcaggtcttccacaagctttcttcgcgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccgttaacggtaatttcgaaaacgtttggtttttgtcctcttttgatatagtactttttctcatcatattccatccacagttcaactaaaagttctttcttatttgtgctgtttattaattgacctttctttacatcacgaaatggcttgccaaaaagcccaaatgtgatggcttctagcatagtagacttaccaccgccatttcgtccagtaataagagttttttgaaccttatctaattgaatgtcaatcccattttgaccaactgacattatatttttatattttactctattaagtttaaaattcttcacaaaagattccttttaatgtatcttttagaccattctatcatatcatcataatctaaaaagtattcatcaaattcagccatgcaaacaacgccttgtgctgtttttgatgtaatataaattattccaacatatctagaatcttcttcggtataatcaatgtttgctatgaattcatcattaatgtcaaatgtcgaaaacttcacagtatgcatccttaatacaagatacagccatatctcgtaatgatttaggtgtgtcattatctaaaatgttgaagttaaaagatacagcccagtcagtgcagaccgtgacctttttaatacaattatcttcaacctctagcggttcaaaccaatattcaataatttctttatgcccaatatcatcttttacttcgcattcaaaatgttgactcatcataacatttttaaattcatcaaaagtcattgtgttgcctctacatatagctggtttgcatattgaataagtgcttcacggtcagaatcagtgatgtctggaattgcattaatgtattcttccatcaacgtctgaagagattgaacttcaacctcttcgctgtcatctgactcgacagagttatcaatctttgacacaactcgtaacgaatgcacaactttctctagttcagattcgaacttcgtcagatttttgtctacttcagttactataacacgtactgatagatttgtaaaatctttatagtcaatttttcctttaaatggataatgaattctacgatgccaggtagtattgtttggaataaattccattcgttctgtttctgtatcaaacatccagaacccacgagggtcattctcgtcacctgcagttagtgtccatggtgtcccaatatatctgacgtttgcagcctcagaaatagtatggaagtgaccagaccacacttctttataagtcttaaggaaatcaggttcaagaccgtgagatttcattcctttataaaaataaaatccattcagttcccagtgaccaacacaaaaagaagcagatgaagttttgatatgctcaagaatttcaccagtattttcttcacacatccaaggaattaaatcaattaaacatccgtcaaaatctactgtagtaggcttatcatatactttaacattaggatatttagccaaaagctcagtagaggcatttggagttaaagtatttttaaagtgcatatcatggtttcctacaatagtatgtagggtaataccagcatcatcaagcatttgaactatttcacgagcaaactccatagttttatgcgtgattgcttttcgcacatcaaaaatatcgccgtattgaatccaggtagtaattccatttttcttagaatattctattgcttgtttaattccatccaactgaatggattgaacccactcatcatcagctttaacgcctaaatgccaatcacctaaatttaaaattttcatatatcaagaaccgtcattgaaatgcaaaataaaattattgaaataaacccatctggtgtgctaaagaaaccaatccagcatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcatatgctttttctcgctcacggtcataaagagctcggtcagatgacagttctttaatacgttcaaacgttgattccatatcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaaaccggatttactcatgcgttcaagcatttcgctatttacataacggtcaagaatttgcgttggcaaattaggagcaattttaatttggtctacttgatgaagacgataatactcgtatggaattcccttttctttaataggaatgaacgctggagaacgttccagaccttccataatagtacttagtcctgcaggtttaagatgtttttcatgaaaatcaaacatctggtaaaaacctttccatgtagtcgtacgaccaatccaacggttgatattcatgttaatttcagaaacatctttccagtaggttgatcgaaccttcgcaatatccataggaggctgaaagttgtatacggtcggtgcttcttcaatatcatcaaacagagaaactgtttcaggataccactctttcatcaaaactttattaaagtcaccattatcagaatggctaaaaataacatcagctcgacgaacagtttcttctaatcccaaatttcggcgtaaagaaagagaagaatggtcatgctgataaactacaacacgaaccgaaggtttaatgttatcaataatttttttatagttattaatagtgtcttcttcaaccgaagtagcaggaactgaattgataattagaatatcacaatcatttaccagcttaagtgttttatcatattcttttgccaataaaaccggaattgaaaatgatttataatcatgcgcgcaattacgagtaaatgatttatctttagcataaaccaaagttacttcatgaccattcttaataaaccaatcacgttgctcaagagaaaatttagttacaccacaaccttcaagacctcgagccataaaaatacatactttcatttattatcctctttgttttggtttattttaccaaaaaatttataaagcaatataggagccgaagctcctatccacataatacgccatacagaggctcgttagaacttttaaattttatgcgcttatattttatagttccttctgctttagctttatcatgagactctttaaagcgtctcatcatttcctcttgagaggaacgaattttattataatctatttcagaagtctggtgttcatctttcataactgccaccattttttgacttgataagaatcaacccacactttcatattggggtctgctcttacaataggaggattaacttctttaattgaactatcatggtattctttttcagaaattttcacacaaagatgaccattcaaagattcagtaaatcctgcattaattttaagacgcttgaattttacgtgtgtaagcatcaatcatatcctcaatctgcgatctagtagtcttccaaagaatactgatgagttcatcgttatatggctgtttcagaatatcccgacttttcttgatagcatattcgtattgagcaaaattattgttttcagctgcgatctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgatacctgtaatttaattctacaccattagatttaaaagcggtatcatacggattttctggatcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacggctgtcatagacattgtgaacgaagtaactgtatttctttgcaacttccttacgttcttttttaatacgttggacgaatgcattaaaacaagcttgagttatatatgcatgcgggtttttatatttcgtttcatcaaaattgtgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaaacagtatgcttggaacactttttccatcatctttttaaattcatgaatatctatgtaatgactagttaaatcagcatgatataaaaagtctaaaaacttttcatgtgtgctaacatattcactttcatttaattcagaaacatgactttcccaatatccaacaccagtcttatttgggaaaaatgaaattttcatgtattggtcaacatagaaaatgccataattttcaatagtaatagaaatattaataaatttcatacattcatcaacttagccgcttcaagagctgcatctagtgaatcaaattggtcaacatattcaatcaattcgccgtaattggcatataaccaccattggctaaattcatactcaaggatgaatccatttccctcaatttgagttaaaccaatgccatttgtatttacttcatatccagcaagacgcaaatcgttaataagagcttcgttcataattataccttagtaattttcaggtctgcaaattttttcttgcgttgatttttcatgcgacgaatagttttatcggaaatttcatgcttttgataagctttagattctacaccaaaagctttaacatcaaattctgacaagatatattgaaccaacaattcacggacagtattgcgtccaatcttctgatcattctgtttcatcgtctgatgaagctctttttcccatttatccaaactttgaggagttacaatatcgcctttttctagcaaagaaactactttatcatatgcgtaagaattaatgacgtttttaatttgaatagtcatacattatcctcaattgcgttaaaattttattatccaaaaagggccgaagcccttagctaaactgtttggcacccttccagccttcgtacatcattgcggctgatattaatattgctcctgcgcattttgaatatttgtgattccaaaaccagttcagaaaaacttcgtcatcaataccctgggctatcatattttcaaagaactggcgacgagcttcagcaattcgttgcgataatttagattcaggattcatttaaattttccaattaccattttcatcaataaatttaatccagtcatttactgaccacttagttgtatcgccttttggagtaacatttaaagtatatagcccttgcttaaaaagcattcgtttgatattcataatttcctcagctgtaacgataacactcgtttgatttacgtttagcaactcgttgagaagtattataatcaaaatcatcatcaatgtaaactgattttttcaactttcttacttcaccacgtaattggcgatttagctcatctttaacttctgaatcaatacctttcattctacgccatttatctgagcgaaaaatgttttcaaccatatctttatgacttacaccatcaggagctttacgctttccgaaatagtcataatcacgtacttttaaatctttacgacgatacgttttacccatggagtttaatttccttagcaactgaactaaatgcagcacgatcgcaaatcatgcgtttatgtaacttgagtataatatagcaaacttcaaaactatttacatgagtaacacgaacagcattaccattaatgagataatactgccccttttaatttctttatcaaccacaaccatatcaattcctcaaaggtaattcatatgttaataataccacggtttgaacttgttgtaaacaactttgtgaaaaatattttagggaatgataagaaaggaacgatagcttagaatggtaatatacagaatgcgagaaagaaaggcccagagggcccgtcttaatcttctatgatatctctatcatatccaagtgaaatgagagtttctttgaagtgtttaatgttcttttgtctagaatcattaatgaaaatgacaggataccgaatattaagagatgtgaatccggcgcgtttggcaagagatacaatcaatgggcgatcgtactcaatcttaccattattagtaagaactttatagaaagtaaaaggagcattgagctcctttagaagttttgtaactgattgacatccaggacaacgacctacttcatctggaattccatagacttcaatcttattctttaagttcgagttttgttccacgagaaataattccttggtaagcccaataaggaggattaacagaatcctcaccagagttttcttcaggaaaataaacctggataacgaagccggattcatcaaaggtgaaataagtagtaggcagttcacctaacaaatcggcacgggcgttgatttcttcgaggtcttgttcacgtccaacccagaagcttgggttcagactacattcatagaaataatagtcattaccgaacatatcaaaaccattccaactctctactacataccgctcaaaactaatcataattaagcctttttatcaagaacagcattcagcttattagtaattttatccagacgcttattgaactcactagaagataagcccttttctggagaaattaaactaatcacgaaaaatatagcaataaaaggaataaggaaaatagctccaactgccataaacagaaagaatgttacagttgtaagaaaatcagctaaacctttacgaaatttatacatattttacccttaattgattaaccaagcattgataagcactaaactatattgcgaataaaactctggaccaaaatgaaaaatcatatcatttatagtatccataatgtaattcaatttaatcatgtgtccacaccccatcggtatttgaccaaagtcgctgattatctgatcctcgccacagctttttagtcggaagatttttctcatacttcccatcaataataacatcaacatatttaagcatttctagttgtttaatatcttcaaacttatatcctgtccacaaccaaatgcttttattgggataaagattttttactgtttgaacgatgcaatgaatcacgtctctgttatcaggataaagagggtcacctccggttatagtcaatccttctatataatcattattcaaacattcaattaattgttctagtgtttcaccagtgaatggaacaccatttctagcattccatgttgatttattataacacccttcgcatttatgcaaacaacctgtaacgaaaagaacgaccctgcaaccagggccattcacaaaatcgcaaggataaaatctatcataattcataataatatccaatttttccaagcttcatcagtagaattacagcgttttagtataagatgtctagaaacttttatggcatttgagcactttttaattgaatcatatttaataccgtcaactgaaacggttttgctagttggagaaatttttccatacattggattttttgaaccaacttgaagtccttttaaagcttttgaaagcttttgtctagattccaatgacatgggagaattctttttaccttcaataattcgcttgtgatgaagttcgcgttcttcttcactcaaagaattgtaatattttttaacaccgtttgatatagataatttatctttctcagaccgctctccagctaatttacttctaacatcttttcgcttcatagctatgcttacgtctttatttaaatttgcttgatgctctggcgtacgtttatatttctttaaagcacgtgaaatagctattttagtttcttctgttctctttttacctttatttgctaaactatttttgcggcgatgttcaagtgtctgttcataggcagttccaccttttccaccaggtttaatattatatgtattttcttttagacaatactcttcggttacaagttcagcttctttatcatacatttgtttttcattatcaaaaacatgtaaaatttctttattaaaattttttctaccatattttaataaagcggcacgaatcaatgttcctgaccccatataaccgtcatttatgttatcggtgctatgcgcaccgatatattcctttgaattaattatatttgttattttataaattatataatacctatgcatgttttactcgttttaccatttctttcattttacctaaattccatggaacaacgctaggagttccaagatatccgcatgttcttcttattgtattcatctttttaggatcagtttctccacaaatagaacaaacaaatccgttttcagtaggagtcatttcatgggtacttccgcatgtaaaacatttatccactggcatattaacaccaaaataatctaaatgttgtgcagcataatcccatacggcctcaagacctttcaagttatttttcatatcaggaagttcaacataagaaatgtgaccacctgtcgcaatgaaatgatatggcgcttcacgagaaatcttttcaaacggagtaatattttcttctactgagacatggaaactgttagtgtaccagcctttatcggtaacatcttttacgcttccatatttttctgtatcgagtttacagaagcgataacaaaggttttcagcaggagtcgaatataaactaaaagcaaatccggttctttcagtccactgtttaagatgagcattcattttagttaaaatttcttgtccaatatcacgaccgacaagaatattcaattcatgaataccaatgtatcctaaagacactgaacttctaccgtttttaaataactcaattatgtcgtcatcaggtttaagacgaaccccgaatgcaccttcttggtaaagaataggagcaacagtcgctttaactccttttaaggaactaattctacacatcaaagcttcaaaacataaatccattcgctcattgaacaattcagtaaatttctgttcattgaactgtgttccaatataagaatccaacgcaatacgaggaagattcagtgttacaacaccaagattattacgtccatcaagaatttcattaccggttgaatctttccacgcgctcaagaaactgcggcaacccattggagaaacaggaatagatgagccggtgatagctttattgttcttagctgaaataatatcaggatacatccttttgcttgcacactctaaagcaagctgcttaatatcatagttcggatcgtctttataaagattaacgccttcttcaacgaacataacaagcttagggaaaataggagttatcccatcacgaccgagacctttaatacgatttttcagaattgctttctgaatcattcgttcagtccagtcagttcccgtaccaaatgtaattgttacaaaaggagtctgtccgtttgaactaaagagagtatttacttcatattcataagcttggaatgcatcgtatacatctttttctgttttagattgagcataatttaacgcatcagcgatttgccatttttctgcatcctcaatatgttttgcataggtgcgtttaacataaggagaaagtactttatctacattagcaaaagtcgttccgccgtattgatgggaagcaacctgtgcagtaatttgtgccataattgcagtagcaacaccgattgatttaggagtttcaatctgtgcattaccaagcttaaatccgttttcaagcattccttttaaatctactaaacaacaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaattgtgttttggtgtcagattcattatattcaaatcctctttgaagcatctcggccatcatttcctcttttcctaaacgagaaaattcctttgatttatctccaacaaagttagggtgaatattattttgggtgtaatcggattttaaataagtaagtaaattttctaaccattcaagataatcaacaccttgtccctttaagccagaacgattaaatttatgcttcatttgaccttctgcggcattgcagagattacaaagcaatccacgtatctttcctgcttttggtccatttaattcatggtcatgatcaagatgattagcttgaacatcaggatttagttctcgttggcaaattaagcatttaccattttgtgcatcataaaatttttgtttttcttctttgtataatttgccagtcaataacataataaaacccttaccttaaatagataagggtatttattatttttaagtattgtaaaacattcgatgcaatcgtttatactgtcgaatcatctttttagtaggacgagaataggttcctacgcaagtggtcatatgagggtccgtagaatgtcctttaataaaaagtttccaaaccttaccgccatttaacttttcagtataaaccaattcggttttcattaaaatgtcctgtcagaaaaagaattttgagttttttcaagtattgtaaaacatttgatgcaatcgcttatattgccgaatcttttggtcagaaaaagaaatttgagtttcaagccattcaatgtactctgcggcagcttgcatcaggttaccttcatagccatcgttattttcttgcgcagctaatttagctaatgcatatgaaatacgttcaccttgaaaagcggctttaggcttctgaacatcttggctagttctctctacaacttcctcgatttcaccattttcaacggattcagtattccacaaacaccaatacgtaattggcttatcatagatgttaataatttttccatcagaaagttcaatttcaataattccagtatcaggttctatatcatcttcgcattcttttgcaagttcacgaactttaaagacagtacctgcactaagttccggccagtaattacatagccctgtatcaacacgattaattctaaaccacttatctactgtaatcatgtcccatctccatatcaattaagtcatttatcgttggttcattatatactgtttcttcatcagtgtaaaccggttcttccggctctggctctacagtttcccatctagccgcccaccaaggtttaaccccgaagcttattaagttcttcataatcaatccaggattctaatcctgatggcaaatcagattcaatttcccaaagaagctcttcaattttctgaagacgatctagttcttcggctggaatagtaaccattgacggagttcttgatacattaatatcgtaaatcatatttaccccaatttaaccatacaatcgccgtatttccacttagaaatagacttttcaccattagaataataaacttcgagtttagcacgattatttttaatttgaataaccttggctgtcatcaaagttccatacccataataaactgcaacttcatcacctacatataccgcgcttccgcggtaatcatgaatatagtcagttccttcgagcatcatttaaaatattctcgcagttggtcaaagccgccaatatgacttccatcaggagcaaatacctgaggcattgtcaagccaatttgagtatcacgacctagtttagtcagaagctcagcaattttctcatcgtcaaaaacacctttttccggcataatgttgataaactcaaacggctgtttcttcacggtcaaaagacgttttgcattatcgcaatacacacatttatggatgttgctatcataaccatatactttaaacatattattccttaattcctagtacttgtttaaaagtctcgtcgtaatcaagactttggcccgtttgttctttatgtttgtatataatatcacttacttctgatagcatatttttatatgaacgagttaaagcagatttaagcacgctgtatctatcaggaaatttaccatgttcattataataagctattgctaattcacggactgccttttcagcagtctccatatattctttacgctttgtcattttcttctcggtcaaatcggtgtttacaatggcgacatttataacgaagaatactagtctgccaatgaatcaattgaacctgttcagttccacattcagggcaattaggaacgtttttagaagccctttcacgacgttcaaccatgaccattacagaatcccaattaacaggagggctataatcatcacaaccataaatctttccacgcatttccatatcatcttcctcaccagccataataattttaattagactagaattacttgaagctgcaatgtcttctaatagacgctttttcatttcaatacctcaatagcattgcgtaaaccatttgcttttgcattaagagcttttaacaatttggtgtgttctgcaatttgggcttcaacttcaatcaaacgagcattgagatattcgcgttcttcgctcaagttatcaaccttttctactttaggctcttttacaactgtcttatatgtattagggttcttcagtttaattagaatgcgtgaactgtataacattgaaccattatcttcggtttcgtcatacatttccactacgtccatcatctccaccatcgtgcagagtttataagacaacgaacgaataattttgttgtgcttattaatttctctagctgtcatggtgccgagattacgtgagtaataataaggaacctggatattaattaatactgatgaaccacctggcttgtgtgttacttcatcagcaataacccaatccttaacatgaactgtatttgtacggtcatcgcccgcggtaaatagtttacgagcatgcttaaaaagcatattcacttggtcattgaattgacaagcgaatttatcagcaaatttagtttcgggaatggtagataaccaatcagccaaatgggtctttttaacatcgttaacaatagtaaattcaaccaaatcggttatagatgtcgcagttttaatgaatctcggcttcataaagtttttaatgttatcgcgagctacagtagaagataacatacgagaacgtttaaaccattcaagtaaattgcctaacgaatgagaataagcgttctgagtatctttacagatatgattttcctggccaacatactgaaggaaatcacgaagaatattattgattactgctctgtgtcctatctgataatcacgatgtttagtaataagactgtcaaaataatcaatataatgtttacgagttttcatattcttctcacttggttaatggtttatactccgagccatccttggctttaaattacttaattaactgtaaagcttgttcaagacgatcaagacgattaacggattcttcccaaatctttttagcctgctcatattctttctgcgctttattagaaatttctagaacttctttataagctttttctagtgcaataacttctggacgaatttctactggttcaggcgaatcgtcaagacattcaattagttcctcaagggtagtttcttctttaggagtattcacaatttcatcacatttttgttggtaaatttctttatcagtcggtgagtacgcacactttacttcacggagactaactacaattttatatccttcccaaccgcatatattcttaaaaggataagtatgaatattttctactgtttccatacaaagtaatgcggtctctaactgacgagttatatcgctagcaattgagaaaaatttattaatgttcttttgattagcttctggtgtaaaaaattcataattcacaaaaatagctgctttatttttatcaagctcatattcttttatgataatcatatcagaagcccaaggatggatttgacgataatcaccatagcataatttagaagctgattttagaatttgcttcttgaaaagtctaaaattactaatccaacgacgagtaaaaatattctcagggtcttctttattattaagatgataagaattaacatcaccgaaccaactgtatcctactacatctttagttcgtttaatttctttcccaaatttaccaagaatatcttgattaactaaatatgaaagaagacgagaacctttaaaagtttccttaatatcatctttatattcgcgactagaaattttatgaacttcatgaataaatttgcttgaagaaacaatacttgcatcaatattattgagccattgattgataatggaaataacactattctgactaaacacaggtttaactttatcatcaataacgctattgaatgatttgatatattcgttacgagtcatattaatctcctcagtagaaagtaagaacattatatcacatccttgtggcaaagtaaactagttcagtgcatttagtgcattgttcaatttagaacgttgcttcgtgagatttttgactttttcttgagctttttctagcatcttttcagcttctagcacttcattagttgctttaacgagttcatcatctactgccttgatagacttctcaatcgcatccgcgtgccatttttcaacaggtttaagactcggattttcaataggaagaaaattcactttattgaatttccatgcatctttattacctgagctatacatccaaaatttaggatcgtttgatgagcaattagataaatttaagttatcttgcacttcctgctttttctcttgcgggacttcatcctttctcaaaaaatcgtatttaaatgaaacgatcatatcaagttcatacgttgttgtatgttcccaatttcgctcaaaatgaggtaaaatcttagactgaacagcggcaacaacatccatatacttaaatgcttctgtcaactgtgatttaaggcattcacaaattgaaagagaattttttgtattaggtttaaagctaattcgtgcagttctattattttcttttaatggtcttacttccatctgaagagtataaccatcaaatttcagattctttaagttaatgtcagaaccttttaatcgactagccgtcgacaaaatttgctttaattgtttacggaatagagcaataaatctccattcaagacggtaatgatttggattaaaaaatcctgttgataaatcaaccttactctgaccaacgccttgaacaaatagaggatttttataatcaatagttttacagaaatcggtgagctgttcgcgagcagtcatttgcgtaatatatccagctttatcaaaatgtcgcagccattcactgctattcatatacttaaagtgaatggaactattaactctattagggtctaaattattttggcacaaaaatgtcataacatcacgagtataactggcattacgaaccatatcttcaatttgagaacgagttttcatggtgttccttaagatttaagtaaatcaacaattttaattaacttttcacgctcagatttagctttactactcaatccagatagtctgaaaatttcatcatcatattgttgaatagaaatattcagctcttcaatctgtttattaaaataatcaatttgttcagaatgtttttcgttactacgaactggtacaggttttgtaggcaatttagttgaactggattcatccgggcgataaattaaaatacaatttgaaccaatcgggcatttagcaccagacacatattctagtgttccagcttcttttaaaacttcaaaagctaaacaaagatgatgacccatattgacataatctgtagagtgagctctgatataataatcatctccacgagtactaaatttaaagcatttaaggtcttctgtattattagttttaaaaatcatttgtttatctagacctttagctaatcgagcacctaatgctaataatcgtcgttgattttcccataaatccgcaatcatttgatcgaatgacaatttcggcattagtcgaccataaaggtcatatcctttattataattgcgaagaatttcactcgcgttaatacgagacaacgctccaattttattaagggctttcatgatgcgattagataaactcattccagacccgtttgttcgctgtaaatgtttttctaatccaaatccaatatcaactttaaatttatctaaaattttggcatgaacatctctgtcaataacattcaaatccaaagttgggttaaatctatgaaaaaatttatctggctctccacgacgaaatacagtccattcattcatcatttttttattaactaaagatttaattactgcattgacattattaattactactgacatattttcctcactcaatttcaattttactaaatacgcagaatataatggaaaagactatataagcaccacacacagattgaactaataccattccaaagaaccaaacaatattatcaaaccatgtctgttttacgtcgaaaggacgtaaacttacagtaatattatcacctttttctattgaagaatacatctccggtgaaatatattcgctaaatctataaccgtctttgagttcatatacagcaataaacgataaactagacccctttccttgagttcctgtaagggtattaactacagtaacatcataatctttataatgcatataatcattaatagcataataaccatatgcaactactacacataaacaacatatcaataaattcaatcttttaattatcaactgtttcataataatctcaattaaaagggcttagaaccattataccatccttggtataaagcggttatgcgagtaccgtctttaaccgttcttcaaacttccgaagagtattttggcgttcagctctttgctttttgtaagtttcaatacgctctgaaatgagagtgtatcgttcatttactgattctttcataaaatcaggaatttcacgagaagctttaatctcatcaaatttatcaataacagcttgctcttcagcaattaagttatcatacatcaaaatatctttcttgatgaactcaatatcttcttgagttacacgagataatttagatgctttatcctttttgtactgttcgttagtatcacgagaccagtgtaatgtacgatttttattcgtattcttgtaaatttctacaataccaatctcatcaataataacgatccaattccaactggatttgtaaatttgtcctccatcaaccgtgatttcacctccgattgagatgtcattaaagaacttgctttgtgcttctgatttaaatttaccatcgttgtaatttaccaggttgaaaatatctttagcgttcattttgtgttcctccgtagttgatagttgtatagtaccacagaggaacagtcttgtaaaccactaaaagaaacttctttcacaattttttccactgaaccatgcgcttaccgctttcttagtctcaggagcagtgttatccataaaccattcaaaggcagcctttttatgattctggagggcttctcgggctttaatctgctcacggtctattaacactaacatatgagcctttcttgtcaccaggggcttcttatgattttttgaatactcccaatcatttgtccatcgcatcgttgttgcgaattgaagtacagcttccttaatcttagtttcgtaaatttcacgagcctttgagtataacatcattacctccatttaccagtttaattctagtcatctttttgatggcagtccatataatctatttctgaactgcctttttgtcttagaaggcctcttatgaatttatttcagaagagtaaccgtagcgatttcttcccaaccgtttttgtcggtcataatgaagtcagcaagataaagagcagtacgcagtgaaacattacgtaaacggttaacattgactttcatccatgataatgctttataagtttcttcatcagaaagaccgcgcttttgcatcatgtcggttgaaagaataacatcttcaaccctgaccataatttcttcattagtgtgaacacccaaatctaaataaactgagcgggacactaatgcttgtaaatgtggagcaagtttagtaccacggtctaattcgcggtcaatatcaacgtttgtgataaaaacaatcgttcctttaaattcaaactcacgctcaatgcctttttcttctaagtaagaagatgcagtgctccagcagactttacgggtctctccagtgtccagagcagctttcagaagattaagaatgtccatatcagagaaaacatccacatcatcaatcaaaaggacagaattctcttcacgattattccagagctgttcataaagaccgataccagagattttaccgttaatgcttttatattcaatgtatccaatatcatttgctttatttaaagctttatctaaagaatacgttttaccaatacccgccgcaccagagataattaatgaacgaatgtttccgttaataataccattcgtcatcattcccataacattaaatcttttattaatgcgggttttcatatcttcatatgattctttaacttcttcaacttttacaccatcatatgaaatgtctgatttgtaaacccaaacaccgcgacgcttaccgtcaatttcaacaaaaactttaccatctccttgtgcatccaccggagcattatctgggaaccattcgcctaagagctcaaaagttccagagatttctttaccaaagtagatacccttattgatagttacagttttcattttattctccaaatccgtatcagttgatagttgtatagtaccataaagctttatgcttgtaaaccgttttgtgaaaaatttttgaaataaaaaaagggagcccgaaggctccctatcatttataataacttcggtggttttcaagatagaccttctcaaggaagtcatcccagaaacccatgtctactttttgctgcataccgttcttagaagcttcagtagatgctgcttctacttgatcgaccacatcttccaaaaactcttgaacggttttaaatggatgtttacccaacttcacgtcgagaataaatggagcgtcttgaagtggatagactaagtcgccagttttgtaaatttccaatagttggagtccaccacggcaagcatgactcaaagctttccagtcaataccttcattggcttcggccttacgagcacgttcaccgtattcagcatctaatttattcagtgactgcttaagctcaataagagaaagcgttgtctgatatttacgacccaacactgtgtagaacgtttgtgggcctgttttctcatgattatggaacacccattcacagaattcgttttctggaagacgatgcttaatatcttcaactttagtacgacgctgcttaatggaaccgtcttcttggtaatcaacccattgctcagggatttgattaactactttcaatacatcacgcaatgcggccaaacgagaacccttaacaccatatttagaagcttgcttgcggacatatcctaaataggatttcatgttagtcgtataaaaacgagaacgattgtcttgaataaacttccatacatcaggcaaatctgatttaaccactagctcaggtggagtgtgaagcatatccaacgctacagtttcaccatctgctgctaatttaaagaaatatttaagactgtatagttcatggtcaatatcatctttagtgtttttagatgatgtgttgttagtgtttttactcatgtgctctttgacatttccgataagaatatcgcgagcaggaggaacaaagatttctttaaaatcgacatcagattctggtgtagaagttccataaagatgactaccaaaataacttttcattactgttttcatcattcagccttatattcaataacaggacacactttagctttacgagcttttaaaaattcaacgataatcgatttcttgggttgaataggaggtaaacctttatttttcctatcaatgttttctacgtgtaaagcataatcctttttccatttataatctttatatttttcatgcaaatgtacaggaataacaaatgaaccaataataagtaaaacaagcaaaatggcaagtataaatgccgatggaagaagagtccataaactaccgaaaataagccatttctgtatgatttctgcacagataatagttagacctgcgagtatagtacatccgaaaaaagaaacgaaaaatgtagggataacaatagaccaaaagtatgcacacagtgtcttaggtcgtttccattcgtcgttaaacagtttgaataatttatagtgccaagagttttcattaataatcataattatcctttcattgaaggtgtaacagttgttaaatacttaatcatagcttcagcttctgattttgataatgaaatttcttcattgttttgacgaatagaaataaaatccggatgacggtcaccaccagcttttaaaacacacatataagtatcagtttcatcttcaatatctgaaatgattgaagcagttccacatgaatgtggtttttgataaatcaatacagcttttcttccaccgtttgactgttcataaacttttaacacatcaaacaaatcgcttcttttatcaatagctaagatgttgttttcatcttcaatattaaatccttcggatacttcataaagtgtcacccataaatcaccaatatcaataacagcgttcacttttccatgactttcaagagcattacaaattttcttaatttcatcataactcattttaataatatcatctccttgaataaggaagatgtcatttttaaattcaacacgaattaaaccacttccacttgaaataaacatatttcctcactttgaaatcatagttggaatgacagaatcgagataagtctttagcgcaatagcttcgtctttggtaaatgtgacaatatgtgatcgaaaatcatcaatttgacgaatagttaagacatcaccatcttcatagcattttgatacgtttaaaacagtttcatcattctgattgcaagcgttagtaataatagcattgcaatttttgagccattttaaactatgttttctttcattagaataataaaaatatttaatcttagctataaaactatcccaatggataactgataaacacattgactcacttttaatattaaatcctgggcatgaagaataaaaatgaattttgtgctcatcattgatgcttactattttatcagtataaggatattcaatttgggttaaatgaatgatttcactaggcgtaaaatatagcatatcgtcttcttgcgtcaaacgatacatgttatttactttttctatagccaattcaccaaaaagcggactaacttctaatactaatcgtttcatattgattctcttcgactcactcacaattacatactcctttgaataatatcaataatgttgttcaccagattataagtaaacattgggtaattatattgaatcattacatacacaacaaacaaaactttcattctcttctccttgacagttgacaagattactataccataaccttgccaacttgtaaaccgttaaatgttgttttcaataaaattctgaagctttgtgtgagcatcaaccatgattttcatttcttctttggcgaaagctgtacctctttcccgagaagaacactcatagtcagaaactgcattagcatattcttcaattagtttcattaaaaacatctgcttttcagttttcattattccacctaatcatttcaagatattggactaacttagctttagatttatccaaatcctttttagctgcttctataccgtcgtatgaatatccttcacaatgctcaactgctaattgatatgaatctatttcaacatcacgtgctaatttaatgattttttcaaactgttcgtgcgttagcatacttaaactctcgtattatgatcgataatttcatcaagaaacatatctaactcttctatagcattatccactttagtttcaaagtctttaatgcctttattcgaaatacccgatgaataccaagcaaagtcaatcagctcttcatctgctttgcgaattgaagccactaattccttaattttatccgcttgcttttcagttttcattattccaccacatatgacagagagaatattgcacacgccatatgcgttgcagcttcatcacacatattataacgtttcttcaaaaattcaacaagttcttcactggtaacttcatccatgtcgacgaaaaaatcaccattaatgatgacgtagatatttccttcttgattgagtgcttcaattttcatgatgttctcctctttatccgatagttgtatagtatcacagctcaaatggaaagtaaaccggtaaaatgaaaaagtctcccgaaggagactaatgttattcgagggaaagaagatatttactctggtaaaacatcccagtaatatcatctatcgtgctttgaatggctggaggcatttctttataaatgctgttagattggtctagtatgcgatcaatcattttaattgtgtcggtaggaagtttactggcatctggaatagaaggcgtgtattttctaccagaataccccaaatattgctcaccaaatttatcaatcaaatctggcaactcagagaaaataaaatcgtatgctttgtgtctagcataacttttagtttcaaaatgcgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgctctatacattcaaaatcggaagagcacgggtcatttttataagtcgttcgcataaaactatagaactgttcagatgattctacgcttttattttcaaaaagcatataaacgtgtctaataccagattccataaatttatcaaaatgaggatcgacattcgcttcaatcggtggagataaagcaaacgctaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagaacagtaagattgcgaagttgcttttcagttaattgtagcatatatacccctttagttagataaacctatttataacttttgcactaaccgagctttttagttaattcattccaatgttttctacacaaagaaacataaatttcatcaccaatacagatttgattaccttctttaactggtgttccatcttccattaatcgagctgtcataatagcttttttaccacaatgacaaactgcctttagttcaataagtttatctgcaatcgccaaaagttctttagaaccttcaaacaattttccagcgaaatcagtccttaatccataagccataacaggaacattatatgtatcaacaattcgacttaattgatgcacctgttcagtttttaaaaactgggcttcatctacaaatacgcaatgaatatctttttgtgcttcagcccatttatagaactcgaaaatatccatatcatctgtaataatattcgcttcctgtttaattccaatgcgagaaacaacttcacagacagaatcgcgagtatcaatagcgggtttaagaactaatacactcattccacgttctttataattatgtgcggcagtcaaaagagaagcagattttccagcattcattgctgcataagtaaaaattaaactcgccatatcaccttcttaaagcgtattcacataagctattaattcattttctttcttatcaaaccgatcagcaaattcttcctgctgttcgggagataacgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattgacagcgagttcaattaaattatcaagctcacgtaacacttcatactgtaactcaaaactattcatttcggtttaccttctttaacgaaatctggataaggataaaatcccgaataaaatccttcacctttatgattgatgcatcctttattagaacaatagcaccaataatcgaaatcacaagccatttcatcgttgcataaagcaaaaacaactggccatttacacctttcacaatgggcatttttaagaatactagtttggctcataaccatgtaacctttaagcagtattcttctacatgctgtttacgacctttcttatcaataaaggtatattcaacgaatgttccaatgtagtctttatctacatcatgtaggctattaattggacatttagtacggcaaatgcgttcccattgacgaataattactgccttattctttgggtcatatggatgtggataatgtatattcataataacggttcccaatcaacaatcacaatttctaatttagaggaatgtgtatctaaaatcccctcaataatatcccagttccctttacctatgcctgcaccaatcctaggcatatagattgtaggtttaatcagtttattttcaccaaactcatttaattctaacatacaattcattaaagcggaatactcaaaatttggccctggttgaaattgagtataaaggttgaagcaatacgctttatgagtcctaaagtatttttcatagactgagtaagaaccgagtttagttacatcaccccattcagtctgtaatttatcagcttccaaaattttagggaaagctttggttaattgacccgctacgcctgaacccatagtatgaaaacaattgcatccatgcgcaatatttttaccttcagcgaaaagggcgacaatatcgcccttgatatattttacaatcatctagtactcaatcctcgattataagaatctaccaaacggtcaaccattgaatgacaagcggctttatctttctcctccgcaactgaacattctaaggtattccactttttagcatatcgttttaataatgtatcgtttttgtatctgcttgatttatctctttctccgtctttatatgcatatattaatttctgcgcaaattcagcttggcatgctttatttttcccacaataatctgccgcagtgcgatttacatattctctaatttcagtatatgatgtatctgctgacgcagaagcagaaaatgaaattaatcctatacataaaaccaaaattttagtcatttactatttccaaaagtttattatttttaaggtaattagccttttctaggacttcagaagcatatttagaaccagctttaacattccatcccgaattataagaggatattgcttttcttatatcgcccttatgtatatttaaccaataagaaagttcaatgtacgcccaggaagctgaattggatcgtttattcaacattctttttatttcagcatcggtcatattataaccaagttccttaactcttgctcgcatagtaggcaaataattttggaacattccataagcgtgatgctttggtttagattttaaattaactccgccagagctttcttgccataaaatagcagccattatatgacctaatccgctcttgtggatatttttgtgtgttttatattttccatccttagaaaattgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactattgataattgccatcctgcattgaagcgacgggtctttgaacttcgcattaggtttacaaactgtaaatccaagccaaagatttccatctgtgatttctaaacgtccaggacggtattcaaccccatcaataaaatcctcatcaatgtcaggacgcggaggcatactcaggaattcattaacttctaaaacatggtcttttattttgtggaataattcaaaaacatatgtctcatcaatctcccgttgaattgcacgatcaagaagatgttgagaatattttagatgaaacgatgagacccctgctgcttttgatgcctcacgaatctcattgttaatttgacgaaactccgactcaaaatgacgacgaagcttatttcgacggataaaaacttctgtattgatagtcatgttgttctcctcttaactgatagaaaaattataccacagtcaagaggaaaagtaaacagttattctttaaatctaatcaatttattcatagactttgaaacttctgcacgaacctcatgtagatttttgagctgttcaagacgctgcgtatagtaagcaatttcatcttcttcgagacagtcctgtgaatcttctttaagataccgtgcatagtcctggaaagcgttacggactacttcctggaagtcatcaagactttgaattttcttaggagcagcagacacacgacgaggggcagtataatactcataaccaaaccctgcgcttaattgagccattagtatttttcctctggttggaacacagcacgacaagcccacatactggcttctttgagtttcgttttagcaatagctaactgatcgaggctttcagcataattcttcgcgagttcaaagtcttcgcaatcgtcccacgcttcccagaattcatcatataaagcatcaaagataagtcctaaacgaacttcagcgtctttaatagcatttactttaccgattttttcgtcggtatgtggtttataacccttaatatcttcaatcatatttgacttcctcaccagtgcataaatcgtattcaactaaacgaataggttcatgaatgccatatccctgaacagaaatttctgtcgtaggataaattccatcaatatcacccatattccaggcttcattaaattgctgttcgcctgaattactaaaccactcggagaaagcatttagcacatcttcagaaccttcaataattatctttgccattacaaactctcggtaaaggtacgagcgataacgtcgcgctgctgttccggagtcagagagttaaagcgaactgcataaccggatacacggatggtcagctgcggatatttttccggatgcttaactgcatcttccagagtttcacgacgcagaacgttaacgttcaggtgttgaccaccttcaattttaactgtaggctgtggctcaatttcaatttcacgggcatgcaaaccatagaaaatttctgggtctacaaaagagtcctctttaaaggttttagaaacgataattcgtgcttgaataccatcttcaaaataaatagtgcctttgtgtgtgccttcaagaatttgatatgctttcatataaacctcaattagaaaataaatttatccaagattgttctttaattaaaaacggctcagaatcatatgccattaaactttgcgtaattaatcctttaaaaggtccatcaataaattccatggtaaaatacggaattttattcattaatcttgcattaggagcagtgcacaaaactctgcatcctttgaatacacctttttgtaatttgtattgcttgggataaaattcgctcaaaatgttattatttgctaaaatttcaaaatgattcaccaatttatttttaatagtttttggcgaaaaataaagatattcgaaaagctgagtgtctgtcatcattgcattccgattacgaaaaactgtggacgagtaataccaccaatgcaacatttactattgcagcagtgttgcacagtttcaatatgaatatcgtaaattttatccatatcaggagatttaacaggctcatcaattatatacaaaattcgtgaaagcgataaacctctgaacttgcttcctttattaccaataaaactgcgcacagaatcagtaaataaacgaaaacgtatatcatcattagaataacgcgaaaattcctttttaatgttatttgcagaaattttagcgtaagctgaagtattagaaagaacaataactgttccgccatcatacaaccaattagcagcgaagttagtcacagcaattgatttaccggattgacgtccaccatctagtcgaagtgtgcaatactgtttaagtaagtcttcaaatggtgggatataatcgtttttacaaatttcttctactctagcatcagaatggtgtgtaaaagcattcatcagggatagataaggaccagttaaaaatgttctcattttattctctctaaatttgggccattccatggcgcatgaattgtccatttctgtatttacccattaccgcactcaggctcgaccttattacaggttggcgggaatccctcatagaatcatgaggtccagtttgttcccatatttcttatttgcttatttgaacgatttaacgtactgaatagaacctttactatttacaaaggcaattttaccatttttattatacattgtagcagtacgttgatagccataagtttgtttaccagattgataaccaactaatgcaaaattatcttcacccattttattctgtttagcgcgaatgcgttcatgaccatgtgccataagaaccttagcatcaccagttgcaatggatcgacgagttttttcatcttcaactgtattaacaaagtcgtcaaatgaatcaaatttagcatgagatttattatacagttttccatctactgcataattatatccctgtacatccatctcaacttctgtaccatcatccaatacagcagtaattttttgaccttttttaaatttcaaaagatcagtaaaagattcagcaataatttgagaattaatagctgcttcagtgataaattcttgatatgttttcatatgtttcctttaaatattttaattagtaatttgtctcttcaagcaactgtgaatatactatcacaattctaggagaaagtaaacaactttatagatttttatatgcgtcccacgttccagttctaaacgtagcgatgactcgttttgcgcgattaggtgtttgattataccatctacttttagctaagttaactgctgcttcatcccagcgtttttgttgaagcatacgtaaagaattagtaaatcctgccacaccggtttctcccatttggaaaaccatattaatcaatgcacagcgacgaacagcatcaagagaatcataaactggttttaatttagcatttctcaaaattccacgaacagcagcatcaacatcctgattaaagagtttttcagcctcatcttttgtaattacaccattgcaattacgcccaatagctttatctaattcagatttagcaacacttaatgatggacttttagtaagcaaatgaccaatgccaatagtgtaatagccttctgtatctttatagattttaagtctaagaccttcatctatacgtaacatttcaaatatattcataatacctcctaagtgtttatagaaggtatttataaaattaaaagaggttgttcattattcggtaaagtgaaggacccatcacatattgccactgagtacgaggaataagagcaaaagcatccatctctggaatcatgacgccatctttattttcaaaataagactcgcaatggcaatttctgaacatctcatgctctactggaatcgtataataaaataactgtaagtctttattactagaatatttaaatacacctaggtcttctagaaggtctgtattataattgctaaaaccggtctcttctaagcattctctttttgcagcttccagtgcattcaaatcagaactttctacgcggccctttggaatatcccagcgatgtgccatcattccaggcttacgagaaccagtaacccgacccataaataaatctttatcttctgtcataaagataataccagctgatagtgttttcattttaatttcctgcattcagtgataaagttatttaaattttgagtatatttcttttcatcaaaaatcttttgttgtctgcgtaaacgccatggcatttcaatgaacatacgccatattcctgataatactgctgctgtaaaaatattaacaagtatagttaaaagaacccaatctcctattctgtccattggattttttataaaaaagtaaaatacgaacgatgatataggaagactaatgatataccacagaagaaccttcttatctgtgaaccaatcagcattcgttaacttagcgcgaccgttttgaatacatacgaacttatcatctgttacagtaaatggcttagctgcttgatatcccattctaaactccctaatcaacaaatttttcatatcttcggaacaaccattccagtcaactctatcaactgaaatgccatcatccccatcatctaaatcataccagcgagtttttaaaatcatttaattttcctacaatcactcacaaactctttcattgactcattttcaatataagacatgtagctattatattcttttaattgtattttgtaatccttttttctttgccaatttattttaaaattatcataatgaaaatataacatggtaccaaagaatgaaaataatgaaatcgctatagtaaaacgaagttcactccaaacctctgttataattactgtgccgtcgatgtttaaaataaaacaatcaattaacaatccaataagactacctgcaagagctgcaaatgctgatacggcaagaattaatagtgcctctggaaacgaatatttgactttatttagttttggcttttgcatcgtgattccttaacaaatttcataatttcatcaaattcatgcgcagcaagtttaagctgatgttcctttttaatctttttacactgtgctttccaatcacgtacgcgtttacgataatgccttccttgataccagtatcctacccaatttacgggtactaataaaagtggaactattaatggaagaattagcattaacacaagtatttcgccagaatcaatatcagtcataacatctaaaacacctccaataatcaatagaattacaaatgatatgagtataacaggacctattaacacatcagtagaaattatctgacgctttaattcatacttcaacggtttacttggaaggtatagtgatggttttgacatattctctacattccttaacaaatttttctagtaataaatcactttcaaaattgggattttctacaaatttatcaaaaagatcatcaacaatagttaagatattctttttactaagaatacgtttattttcatgcttcgtttcagaatcaactataagagtaaagaaatatttcttgccctgaaattttaccgtagtatcaatataaaataaatttgacttttgtaaattacgtttaaaccatgcatcacttaaactataaacgccaagataatcaaaatcgtcgtttaaataacaaactgtccattcaggagaaatgaaatcagtaaattcaacatcaaaatcgcatgtcaatgaatgaattgattcaatactgttaataagtattccaggacgtattaaagactttttacctctggaaaatcttccagaaagactttcatcagtttcatatgaagaaccccaataataattacgtccttctgccatacgtttaagagcatttaataattggtctggaacatcaacctgcctttggaactcttcaaacattgaattgaaatcactttgcattttcattcctatttactccaagtaataggggccgaagccccttatcattatttcagagaattaatgtattcctgaacatcggcagaggtagtttcaaccccagaaatattgccattaaaggtttcaactcgagcaagagtatcttcaatatcaactttagtcagtgctgcaatttcaactacatcatcagcagtactaattccaagggcattcgctgcacgagtttcacggatatattccaatttaaccgcaagttcttggcgtgcatcatccaattcaactactttcttagcgatttcaattcgcatttcagcataaccatcagctttagtagtcaactgctcagctgttcgacgatatagtaaaccaagtttagcatgcattgttacatcttgaccttcagaaagaagcttgcgaatttcacgctcttttgattcggcctgcttattcttttcaacgataagttcacgaatacgcttttcttcattaatagatttaacagaagcagtttttaggtctttaattttatcaagcagttttgctgctgcagcagtatactgttcttcaacagatagatttttagccattgcagaaccaagtttagtgcgaataaactcaacaattttcttcagtgtgttcatagtatttccttaggttaattgagatttaaaatccatgagagtattatactccggatagtttgtaaactatttcaacatcgccttttgctgctttataaccttcagcccaagatacaaccgagtttttatccgaagattcaaattctggcattgggctttcgccaatgttcacgcagtatgtttcttcattttcgtcgaaccaaataattaaagtagtcatttatttctccgttttctgtatttgttttgataagtctataataacaccgtccttggcgtttgtacacaattatttcatattattgaaatattcttctgcgatttcatcgttatcatggtaaactttagaagacagtttaacataaccttcagcagtgaacatgttaatcacaacctttacagtataccactgaccatcttcattacccattactgcataggtttcaaacatcggatggtcaggaccgataactttaatatcattcactgtacgaccgaaatcttctgaaacacatttcataaagaagttgaacagttcgccgtaattatccatttcattctccaagttgtttttgtatcagtagttgatagttgtatagtaccatggaagaacagggatgtaaacagttttgtgaaaaaattttttaaaaagttttagggaattctagggcagggaggggcaattaaaagataggataatatattataaagggtagaaactaaatgatgtctagagaggcccggaaaggcctagataccaaaaagccccaaccttttggtcggggctaagaatgttatttgatttgtttagcagaccaaatgcggtctttaataattttttggatgtcttcaacatactcaagagagtgaacatgtggattatctttgaaactataagcacgggctaacttttggccttcggttttgattactaaaagctctttaaggatagcttcatatttagcgataattcctttaacgatatttttttcttgtgccgctttaggatctgctttaggagcaggtttacccgaagcctttgcaaaagcagcgccagtagcaactaaacttttccaggccatactaactgcatttcccgtaaatccttccgctttcatgtcgcgtgcaaactggaatcgcgattcatcagaagcatctttataggaatatttacccgcggcaatggcagcttttgcaacagcttgaatttcggtgctagatgcttcatttaacaccgcttcatttaaaaattgagtatatgatttcatcttatttcctgttttaattcggggttttaatatacttatttatactaaaaagccccaacctttcggtcggggctaagccttgcggcaaccttgtcggggttccacctgctaaggcaagtgtttgtacgaaacgccgggattcgaacccggttattaagtagttgacgctactcaatatttttaaaaggccatatctcgaccatatccgaacgttccgtcaaaaacgctactcggcttacggcaaagatatttcctcgaatcgataattcggtgcgccgtttctgttgtgatataaggggacattaacaaaacataaagatttattaataccagtccttaaacagggaacatcagtccgacgacttgccggtagcgacccggcttcttgtctggtcgaggcagtagggatcgaacctacgacccaggacttagaaggtccttgctcttccttctgagctatgcctcgtatttggcggacgtgataggattcgaacctataaccaatcgcttaacaggcgatcgctctgccattgagctacacatccaaattggtggggagtggtggagtcgaaccacccgagtcgcaatgacaatgaatttacagtccacaccgctacctctacgggataactccccaaattaatttggtggccctgggtggaattgaaccaccatctggcgattatgagtcgcttgcttgaaccttccagctacagggccttggtgctgattgacggaatcgaaccgccgacgtcctcattacaagtgaggtgctctacctactgagctaaatcagcaaaactggcggaggcgataggatttgaacctatgagtcgccggagcgactgccggttttcaagaccggtgcattaaaccactctgccacgcctccagtctccgcggcaggatttgaacctacgacattctgctcccaaagcagacgctctaccaaactgagctacacggagtaaattaaattggagcggataatgagaatcgaactcacatcatcagattggaagtctgaggtaataccattatacgatatccgcaaatttggtgcgagaagtgggactcgaacccacaaggaaatcattccgcagcattttaagtgctgtgcctttaccaatttgaccattctcgcgctgggaataaaggactcgaacctttgcatctagcagtcaaagtgctatgccttaccaacttggctaattcccaattattaacaaaggctctctaacaagaacccttgatgatagagggtattaatcagtgcggtatgagttaataataacaaataattcttaaagcatatttaccatttatgataatacgtatttacgatacattcaagacccaaaggattcttgaaaatatcatattcaagaggacctttttctgtttcaataaagaaatcaaaatttactgtattaaatttgcggtcttccttcactaatttaacttgagaagatgaacggtcaatgtaaaccttttcaacttcaaaacaggttaaaatgccataatcatcaatcaaggctttagctgcttcttgatcatatttatatccattttcaatggatgatactttagcataaagaatcattatcagccttcatcaacaatagtatgagtattggcatttacgatttgccaccagtcaaagcgattagaacccatcggtttgttttcattttctttgataatgtcacggagttcatcttcagagaatgctttagcgattaaatcggtatacccaccacgtggataataattatcacctgcaaacaaaaggaaatttaccttcccggaaggaacatatgcttccttaggatacttgtttcctgcgtggtcaaccacttcaatataacggtaaggaatatcggttctttcaacccattgccatgccgccgcaggggaatcgaaagcatctacacctaaacgattatcttcatctttagacggattattttcgtaatccgcatatacataatattcaacgttcattattcacctttagaaattttatccataacgatagcaattaaaccaattaaaaatgctactacaagtgaaaaaacattttctgccgtagtcaataatccgcatataaatccaacaaacattgaaaaactgaaagcagaagcagaaattgcaatagcaacatttcgaattaattcacaacgtttcattttattctcctcaatagttgatagggtaatagtatcactaccccatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgttttgatagggtaatagtatcacaactaaaaccctatgtaaacaactttgtgaaattattttaaatcttctaatcgtttcttcatcttagaaccatttttagcaatttctcctgcatcggagcataatgctaaaagtgctttaactttagtttggtctcctttaaaagatgaaggatcgaccgcagcagcaagttctttaatacgagagaaaagacgctcagcttcagctaaagccattccaagctttacttccataccgtgggaagattcagtgatagtagtttttgtagcaaactctttgaaagttttcatttttattttcctaattaattttgatgaggtaatagtatcactacctcatcagtatgtaaacaactttgtgaaattattttaaatcatctgcccaatcgagtttaagaggctctttgtattcacggtcaagtacaaccggaatttgtacatcaccgctaaatgataagggcccaacattataagacaatgttatatgcggtgtgtaatcatcaaaatcgtgtgtagcacctagtgcccgcgcatacatgtgtcgacagcgcagatattcagaatctagcacaagtacaagagtcgatccatcttgtgttttccacacttctaaatgtccagaagaagctacttcaaaacttccactcgatggaacatatggaacatttactctcgaataacatatggtcgaatgaattttttctctaggaactggattaggaacacgtaaagagcgctggagttcttccagcgcgtcaagtgttaattctgaaaacttagctgctacataaagacccgttgaaaagtctttaaattccatcattcttcatctgcagattcagcagtaagattcttgacagcttcaacgatttcttcaactttaatagtatcgccagtgatacctactgcatgagcaatttcagccaaagttccttgcagaattttggattcttccatcagacgagccgcttggtcctgcgtatcaagaatacgagatttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattactgtagcacccatcgccctagccgcatccatttcatgatcttgacgggtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcaataatcttgttaaatgctacggaattaactgattcttgtccttcgtcatcaaaaacaaacacacctttaattgggcttttaccattaagatagcaaaatgcttgttccataatcgtgattacttctaatttagttagatttaaattagtctcacgatcatagtcaattccttcaaactctttacgagttaagcaaggataatcggtgtttgctgcaaatactccccatgcataagccaatgcatccttaataggaccagcaagttggtatttaactgcagaataattgctcatgataaaatcagcagtagtatcttttccactacgctttacaccgcttaaaaagattagtttcatgtgtttctcctcaaatttaattaagattataacacacaaaactgaagcattaaacttccgctataatttttccatctttttctacttgaaaatacgtataaggaatcgttgctgtacatactaaagccgggtctgaatcttctgtgtagctaaattctacttcagataggtcagaaacccaaggcttataaaaatttattgacatcacgatttcagttttgctattatctaaaatgtaaagcgtaatgtattcaggacctgttttttgggcagtattttcacctgtaagatagttgctagttcctagcatccattcatacattcctatccatgacttaagttcttcatcaactataaatctcacgatgagtggatcgtactcaaatgtagcacctggacgttgtgctcggcccagtccaaacggcccagtcacggtatcagtaacaggtattctaattcctggaataggaactgactgagcatttaaagtaaaagcagatgtagtattactatgtggtattgatactacaaagttagttgtatttgcttggttaaaaatttgttgcagtgcttgcgacatatattcctcataatgctttataactgttggtggtataatgggtctaagtcccttccattcaattccatttagaacaaacaacagaaaagaatggaagataatagaattagatatttgaccagactttgtttgcagagaaacgttttccttttgaaacgaactgctgaagtggcattaacacaacgttcgcccagtctttcggggcgatttcaacaaggctacccataatattaccaggtatatatgccttaatcatttggtctgcacccctaaatcctttcacttgactccaatcaatttttaatttcgttttattagtaatagtaggtgtatttgcatattgctttaaaagctcttctagaaactgttgacgagctttaggtggaatatagtgcaagttcaatccgtacattaaattatgcttacctaaaccaaggtaaattatcaaaggaaatttatcccagtaaggaagagtttccttgtgtttagcatcataagcaaaagcatatattcgtcccggctgcgggcgaacaactttatgtccttttacttgcttaatagtttcagcaaaccactttctggttttattattaattgctgcaccttcattacgaattttatcacgcaatgtttgtctgaatgaatttatcataagcagttgtctttcttgcttattgagtttattcattggttttgattcaagcttttgaatcttttcagccgttttaattcctgaagcatattttgacattgctgaagtaaacgtagagtatttgattcctctttcttcagcaaattgctttcctgtcattccttttgctttggcctttttatattcaagacctatctgaatccatttcttttcgtttaatgattgcttaacctttggaacttggggagtgctttcattaattatttgaaaaatagccattatgcccccttaaagccaagagctcgtaatccatcttctgttaaaattctaaattttattccacgcttttcagctaaagattgtgctgctttccatttgtcggtattaacagaatatgtataaatttcattcataaatcttttcttcgctgctgttgttagatgtgctggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatactttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgcttacgtacttattatatcaaaggttcaccacgcccggaagaattagcaaatactatatatggaaatccacagttgtattgggttttattgatgtgtaatgataattatgacccgtattatggatggattacttcacaagaagcagcttatcaagcatctatacaaaaatacaaaaatgtaggtggagaccaaatagtatatcatgtgaatgagaacggtgaaaaattttataatttaatatcatacgatgataatccatatgtttggtatgataaaggtgataaagctagaaaatatcctcaatatgaaggagcacttgctgctgttaatacgtatgaagatgctgttcttgaaaatgaaaaacttcgtcaaataaaaataatagcaaaatcagacattaattcatttatgaacgaccttatacgtataatggagaaatcttatggaaatgataagtaataaccttaattggtttgttggtgttgttgaagatagaatggacccattaaaattaggtcgtgttcgtgttcgtgtggttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaacggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggctgacatgcttcgccgtgatgaaggattaagactaaaagtttattgggatactgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcaaatgggtgttggcggtgtagctaaatttaacacaatgttaactgctatgttagccggagattgggaaaaagcatataaagccggtcgtgattcattgtggtatcaacaaacaaaaggccgtgcatcccgtgttaccatgattattcttacggggaatttggaatcatatggtgttgaagtgaaaaccccagctaggtctctatcagcaatggctgctactgtagctaaatcttctgacccggctgaccctcctattccaaatgactcgagaattttattcaaagaaccagtttcttcatataaaggtgaatatccttatgtgcatacaatggaaactgaaagtggacatattcaggaatttgatgatacccctgggcaagaacgatacagattagttcatccaactggaacttatgaagaagtatcaccgtcaggaagaagaacaagaaaaactgttgataatttgtatgatataaccaacgctgatggtaattttttggtagccggtgataaaaagactaacgtcggtggatcagaaatttattacaacatggataatcgtcttcaccagatagatggaagcaatacaatatttgtacgtggcgacgaaacgaaaactgttgaaggcaatggaactatcctagttaaaggtaatgttactattgtagttgaaggtaatgctgacatcacagttaaaggagatgctaccactttagttgaaggtaatcaaactaacacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgcttatacggaacatatgaatctgtgtttggatttggaaatgacgcgttgaaatatcgtttaggcgatgaatttaaaactgctgcttcatgggaagaacttcctactgattctgatactcagttgtatttatggaaagctcctcaaaacctccagaagacattcacttacgaagtaacattaatatatgactaccaagaacaaagtgaatctggaggttctggcagtaattctaggtcatcttctgatactactgaaccgacagatcctcctgctccagtaagaaaaactctcgttaaaaattatactaaaactatagttggaaattggagtcgttgggctaataaattaagaagctatgtgtatgagaggtcatagatgtcaggattaagttatgataaatgtgttactgctggtcatgaagcatggcctccaacagttgtgaatgctacacaaagtaaagtattcactggaggaattgctgttctcgtagcaggtgatccaattacagaacatacagaaattaaaaagccatatgaaacacatggcggagtgacacaacccagaacttctaaggtatatgtcactggaaagaaagctgttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacgtttgctgaaataaaacaaaacctcattgaatggcttaatggccaaaatgaatttttggattatgattttgaaggctcaagattaaacgttctgtgtgaccttttagcttataatacattgtacattcaacagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattactattcctcgcggaactcgctttttagcatatgcaaaagatacttctgttaatccatataacttcgtttctaccgaagacgttattgctattcgtgataaaaataaccaatattttccgcgtttaaaattggcccagggacgtatagtaagaactgaaatcatttatgataaattaacacctattatcatttatgataaaaatattgatagaaaccaggttaaattatacgttgatggagcagaatggattaactggacaagaaagtcaatggttcatgctggttctacatcgacaatttactacatgcgtgaaactattgatggaaatactgaattctattttggtgaaggtgaaatttctgttaatgcttctgaaggagctttgaccgctaattatatcggaggtcttaaacctactcagaactctacgattgttattgagtacatcagtactaatggtgctgacgcgaacggagcagtcggattttcatacgcagatacattaacaaatataactgtcatcaatattaatgaaaatccaaacgatgacccagattttgttggggcagatggcggcggtgatccagaagatattgagcgtatccgcgaattgggtactattaaacgcgaaacccagcaacgctgcgtaactgcgactgactatgatacattcgtttcagagagatttggttctattattcaagcagttcagactttcactgattctactaaacctggttatgcatttattgctgctaaacctaaatcaggtctgtatttaactactgtacagcgtgaagatattaaaaattatctcaaagactataatttagctcctattacgccatcaattatttctcctaattatctttttattaagactaatttaaaagtcacatatgctttaaataagctgcaagaatccgaacagtggctcgaaggtcaaataattgataaaattgatcgttattataccgaagacgtagaaatttttaattcatctttcgctaaatctaagatgttgacatatgtagatgatgcagatcattctatcattggctcatcagcgacaattcaaattgttcgtgaagtacaaaacttctataaaacgcctgaagcaggtattaaatacaataatcaaataaaagatcgttctatggaatctaatacgttttcatttaattctggacgaaaggttgtaaatcctgatactggtttagaagaagatgtattatatgacgttcgcatagtatcaacagaccgagattctaaaggaattggtaaagttattattggtccatttgcttctggcgatgttacagaaaatgaaaacattcagccatatacaggcaacgattttaacaaattagcaaattctgatggacgcgacaaatactatgttatcggtgaaataaattatccagctgatgtgatttattggaatatcgctaaaattaatttaacatctgaaaaatttgaagttcagaccatcgaattatattctgacccaaccgatgatgttatctttactcgcgacggttcactgattgtatttgaaaatgacttacgtccacaatacttaactatcgatttggagcctatatcacaatgacagtaaaagcaccttcagtcactagtctcagaatttccaagttatccgcaaatcaggtgcaagtacgctgggatgacgttggtgctaatttctactattttgtagaaatcgctgagacaaaaacgaactcgggggaaaatctcccgagtaatcaatacagatggattaacttaggatatactgcaaataacagcttcttttttgatgatgctgacccattgacatcatacattatcagagtagctacagctgcgcaagattttgagcagtctgattggatttataccgaagagtttgaaacttttgctacaaatgcttatacatttcaaaacatgattgaaatgcaattagccaataaattcattcaggaaaaatttactcttaataattctgattatgttaattttaacaatgacactataatggctgcattgatgaatgaatcatttcaattcagcccatcgtatgttgatgtttcatcaataagtaattttattattggtgaaaatgagtatcatgaaatacaaggttctattcagcaagtatgtaaggatattaaccgagtttatttgatggaatcagaaggaattctatatctttttgagcgctatcaacctgtagttaaagtatccaatgataaaggacaaacctggaaagccgtaaagctcttcaatgaccgtgtaggatatcctttatctaagacagtatattaccaatctgcgaacacaacatacgttctaggatacgacaagattttctatggccgtaaatcgactgacgttagatggtcagcagatgatgtcagattcagttcgcaggatataacatttgctaaacttggcgaccagttacatttaggatttgatgtagaaatctttggtacttatgcgactttaccagcgaatgtatatcgtatagctgaagccattacttgtacggatgattatatctatgttgttgccagagataaagttagatatataaaaacgagcaatgcacctatagattctgatccattatctccaacatattcggaaaggctatttgaacctgatacaatgactataactggaaatcctaaagcagtatgctataaaatggattctatcggtgataaagtttttgctcttattattggtgaagttgaaacattaaatgccaatccgagaacttcaaaaataattgattctgctgataaaggaatatatgttttaaatcatgacgaaaaaacatggaaaagagttttcggtaataccgaagaagaaagaagacgtattcaacccggatatgcgaatatgtcaactgacggtaaattagtttctctatcttcgagtaattttaaatttttaagtgataacattgttaatgaccctgaaactgcagcaaaatatcagttaatcggtgctgttaaatatgaatttcctcgtgaatggttagctgataagcattatcatatgatggcatttatagcggatgaaaaatctgattgggagacttttactcctcaaccaatgaaatactacgcagaaccgttctttaactggtctaaaaaatctaacacacgctgttggataaacaattctgatagagctgtagtagtttatgctgatttaaaatacactaaagttatagaaaatattccggaaacatcgccagatagattagttcatgaatactgggatgatggtgattgtacgatagtaatgccaaatgttaaattcacaggatttaaaaaatatgcgtctgggatgcttttttataaatcttctggtgaaataatttcttactatgattttaactatcgagtgagagacacggttgaaataatttggaagccaactggaatatttttaaaagcatttttacaaaaccaagagcgtgaaactccttggtcaccggaagaagagcatggattagctgatcctgatttaagaccattaattggcacaatgatgcctgattcttatttactacaagattcgaattttgaggcattttgcgaagcatatattcaatatctttctgatggatatggaactcagtataacaatttacgaaatttaattcgtaacaaatatccacgagaagagcatgcatgggaatatttgtggtcagagatatataaaagaaacatttatttaaatgctgacaaacgtgatgctgttgcaagattttttgaatcacgtagttatgatttttattctactaaaggaattgaagcatcatacaagtttctttttaaagttctttataatgaagaagttgaaattgaaattgaatctggggctggtactgaatatgacataatcgttcaatctgattctttgactgaagatttagtaggacaaacgatttatacagccacaggaagatgtaatgttacttatatagaaagaagttattctaacggtaaattgcaatggaccgtaactattcataatcttttgggaagattaattgctggtcaagaagttaaagcagaaagactccctagttttgaaggcgaaattattcgtggagttaaaggaaaggatttgcttcaaaacaatatagactatattaatagaagtagatcatactatgtaatgaaaattaaatccaatttaccttcttcccgctggaaatctgacgttattcgttttgttcatccagtaggatttggatttatagcaattacccttttaacgatgtttattaatgttggtttaactcttaaacatacagagactataattaataaatacaaaaactataaatgggattctggattgcctactgaatatgctgatagagtagctaaattaactccaaccggtgaaattgagtatgattcagtaacaggcgaagcaatttatgaacctggcccaatggctggtgtaaaatatcctcttcctgatgactataatgctgaaaataataattcaatatttcaaggtcaattgccatctgaacgacgtaaattaatgagtcctctatttgatgcatctggaacaacatttgcacaatttagggatttagttaataaacgtctaaaagataatataggaaatccaagagaccctgaaaatccaacacaggttaaaatagatgaatgattcaagtgttatctatcgtgcgatagttacttcaaaatttagaacagaaaaaatgttgaatttttataattcaattggaagtggtccggataaaaacactatctttattacatttggaagatcagaaccatggtcatcaaacgaaaatgaggtgggatttgccccaccttatcccaccgattctgtgttaggtgtaactgacatgtggacgcatatgatgggaacagtaaaggttcttccatcaatgcttgatgcagttattcctcgtcgagattggggagatactagatatccggatccgtatacatttagaattaacgatattgtagtgtgtaactcagctccttacaacgctactgaatcaggcgcaggctggttagtatatcgttgtttagatgttcctgatactggaatgtgttcaatcgcatctttaactgataaggatgaatgccttaaattaggcggaaaatggacaccttctgttaggtcaatgactcctcctgaaggtcgaggagatgctgaaggaacaattgaacctggggacgggtatgtatgggaatatctttttgagattccacccgatgtatctataaatagatgcacgaatgaatatattgtggttccttggcctgaggaattaaaagaagacccgactagatggggatatgaagataatctcacttggcagcaagatgattttggattaatttaccgggttaaggcaaatactatccgttttaaagcatatttagattcagtttactttcctgatgctgcattgccaggaaataaaggatttagacaaatatcaataatcacgaatcctcttgaagctaaagctcatccaaatgacccaaacgttaaagctgaaaaggattattatgacccagaagatttaatgaggcattcgggcgaaatgatttatatggaaaataggccacctattattatggcaatggatcaaacagaagaaatcaatattctgtttacattttaaattaagggagcccatgggctcccttttttctttataaatattataaactcataaggaaaccgctatgttcattcaagaaccaaagaaattgattgataccggcgaaattggtaacgcttctactggtgatatcttattcgacggtggtaataaaattaatagtgattttaacgcaatttataatgcgtttggcgatcagcgtaaaatggcagtagcaaatggcactggagcagatggtcaaattatccatgctactgggtattatcaaaaacactctattacagagtacgcaactccagtgaaagttggcactagacatgatattgatacctctactgtaggtgttaaagttattattgaaagaggcgaactcggcgattgtgttgaattcattaactctaatggatcaatatcagttactaatcctttaacaattcaagctattgattcaattaaaggtgtttcaggtaatttagtagtaactagcccatatagtaaagtaactttacgctgtatttcatctgataattctacatcggtttggaattattctattgaaagtatgtttggacaaaaggaatcaccagctgaaggtacatggaatatttctacatccggatcagttgatattccactatttcatcgcactgaatacaatatggctaaattgctagttacgtgccaatcagtagatggaagaaaaattaaaacagcagaaataaatattcttgtggatactgttaattcagaagttatttcttctgagtatgctgtcatgagagttggaaatgaaacagaagaagacgagattgctaatattgcatttagtattaaaaccaactatgtaacggcgactataagttcttctaccgttggcatgagagcagcagttaaagttatcgctacgcagaaaatcggggtggctcaataatgaaacaaaatattaatatcggtaatgttgttgatgatggtaccggtgactacctgcgtaaaggtggtataaaaataaatgaaaactttgatgaactttattatgaacttggcgatggagatgttccatattcagccggtgcctggaaaacttataatgcttcatctggtcaaacattaaaagctaagtggggaaaatcatacgctattaatacctcttctggaagagtaactttacaacttcctaaaggaactgttaatgattataataaagtaattagagctagggatgtatttgcaacatggaacattaatccagttactttagtagctgcttctggagatacaattaaagggtcgtcatcatcggttgaaattaatactcaatttagtgatttagagctcgtttattgcgctccaggacgttgggagtatgtcaaaaacaaacaaattgacaaaattattagttcagatattagtaatgtagcacgtaaagaatttttagtcgaagttcaaggacaaacggactttttagatgttttccgcggaactagctataatgttaataacatccgagtaaaacaccgtggtaatgaattatattacggcgatgtatttagtgaaaacagtgactttggctctcctggggaaaatgaaggagaattgattcctcttgatggatttaatattaggttaagacagccttgtaatattggtgacactgttcaaattgaaacatttatggatggtatatcacaatggagaagttcatatacaagacgccaaataaaagtattagattcaaaattaacgtcaaaaacttctttagaaggaagtatttacgttactgatttatcaacaatgaaatcaattccattctctgcatttggattaattcctggagaacctattaatcctaattctcttgaagttcgttttaatggaattttacaacaacaagctggaacagcaggatatcctctgtttttgtgtgaaggtgctaactcagatacgcaagcaggatgtatatctcttggtggtgaatggaaagaatctaacacagattattctatagaatatgaagatggaaaacctgtcagtcttttatttgatagaaaatttgaatcaggtgatataatcgttataacatggtttaataatgatttaggaactcttttagaaaaagatgacattattgaattaactgatgaccgttatgttagtaaaggatcatctactgaagttactggggatgtagccttaacagattttgataaaatcggttggccaaatgttgaaaaagttgattcttatactagaacgtataattcaatatcatctattttcgatagcatttatcctgtaggttcaatttatgaaaatgctataaacccaaataatccggtgacttatatggggtttggttcgtggaaattatttggtaaaggacaagttttagtaggatggaacgatgatgttacagatccaaactttgcattaaacaataatgatttagattctagcggaaatccttcacacactgccggtggaacagttggaacaacgtcagtaacgcttgaaaatgcaaatcttcctgcgactaaaactgacgaaagagttttaattgaagatgaaaatggatcagttattattggaggttgtcaatatgacccagatgaaactggtcctatatatacaaaatatcgtgaagactatgcaacaacaaactcttcacatactcctcctactaatattagtaatattcaaccgtctattactgtataccgttggataaggattgcataatgagtttacttaataataaagcgggagttatttcccgcttagcggattttcttggttttagaactaagaaaaatgatatttcgattatgaataatcagccagtaggcgctgtaacaatttcacaaatatcaaaaggtttttatgattcaaatgtagaatctgctatcaatgacgttagaaatatggcagagcaaccggttggagctgtattagttaatataagcggcgtatctcctactggcgtgcaacagaccgactattggtcatttgaaggaaccgttactgatacttcagtcaaatcaggtgacccagttattgttaacatgtttggtattccagttaaagctactaatggaatgacttcaattgaatttactagtgccgttagaatagctctacaggaaatggttgtaaaatttattgcaattgattcatttgaagaccatcctaccataggaaataaaatacaagttaagtatttagataaccaagaacatatcttagaacaatactctgataaaggaattactttcaaacaggaaataatttctccttctaaacctgggtatggaacttggcaattattaggtgcgcaaactgttgcgctagatagtcacacacaacctacagtattttattattttgagagagtagcatgagtaacaatacatatcagcacgtatcaaatgaatcaaaatatgttaaattcgatcccactggatcgaattttcctggcactgttacgacagtacagtctgcattatcaaaaataagtaatatcggcgtaaatggtattcctgatgcaactatggaagttaaaggaatagcaatgattgcgtcagagcaagaggttttagatggaactaataattctaaaatcgttacaccagctacattagcaacaagattattgtatccaaatgctactgaaactaaatatggtttaacgcgctattcaacaaatgaagaaacattagaaggctcagataataattcatcaataacgccgcaaaaactgaaataccatactgatgatgtgttccaaaatagatattcgtctgagtcatcaaacggggttattaaaatatcatctacgcctgcagctttggctggtgtcgatgatactacggcgatgactccgttgaaaacccaaaaacttgcaataaaattaatttcacaaatagctccttccgaagatactgcatcagaatctgtgagaggtgtggttcaattatcaactgttgcgcaaactcgtcaaggaactctccgcgaaggatatgcaatttctccgtatacctttatgaattctgttgcaacacaagaatataagggtgttatacgtttaggaacacaatcggaaattaacagtaatttaggagatgttgcagtaacaggtgaaacactaaatggtcgaggagctaccggttctatgcgtggagtagttaaattaacgacgcaagccggtattgcccctgaaggtgatagctctggagcattagcatggaacgcagatgtaattaatactcgtggtggacaaactattaatggttctttaaatttagaccatcttacagcaaacggaatttggtcgcgcggtggaatgtggaaaaatggcgatcaacctgttgccactgaaagatatgcgtccgaacgagttccggttggaactattatgatgtttgcgggtgattcagcacctccaggttggattatgtgtcatggtggaaccgtgtcaggtgaccaatttcctgattatagaaacgtagttggaacaagatttggtggtgattggaataatcctggcgttcctgatatgcggggtcttttcgtcagaggagccggcacaggcggtcatattttaaatcaacgtggacaagatggctatggaaaggatagactgggcgtaggatgtgacggaatgcatgttggtggtgttcaggcacaacaaatgtcataccataaacatgctggtggttggggtgaatataacagaagtgaaggcccatttggcgcgtcagtttatcaaggatatcttggaactagaaaatattccgactgggataatgcttcatacttcactaatgatggatttgaattaggtggaccgagagatgctcatggtacacttaatcgtgaaggattaattggttatgaaactagaccatggaatatatcattaaactatattattaaagttcattactaaggattacaaatgattgaattaaaagatttaccttttgttgatagcgttcctgatgaaggtcaggaacgtatttcatggattaaaaatggtgaagaaatactaggagctagcactaagtatggaaacgatggatcaatgaatagaccaattgtttccgtgtttaaaaatgttgaggttcttgacgaaaatataggaattcttaaaactgccattgaaacatcgcagaaagatattaaaacaattcaaggagttttagatgtatcaggagatatagaagcactatcgcagatcagtgttaataaaaatgacatatcaaatttaaagacacttactaatgaacacactgatatattaactggaactaataatacagttgacaaaattattgctgatataggtccatttaatgatgaagaaaactctgtttatagaacaattagaaatgatttattgtggattaaacaggaattaggacaatattctggccaagacattaacggtcttcctgttgttggtaatgctagcacaggaatgaaacacagaataataacaaatagtacattattatcttcacaaggcattcgtttaagcgaattagaaaataaatttactgaatctgacgtaggatcattaactgttgaagttggtaaattacgtgatgaacttggtaataaaccagtagattttgggccaaatatttataatagattaaacactatagatgataaacaaactttaataaattctgatatagcagaaattaaatcttctattggatacccagaaaatgtttctataataacagaaattaataataacaaaagtagcattgaagctattaataatgaattaaatcagagtgaaggtgttaaacagcgcttaacggctattgaaacttctataggttcagatgatattccttctagtattaaaggaaaaattaaaaatcacacaacttctattgagtctttaaacggaattgttggtgaaaacacttcgtctggtttaagagcgaatgtttcgtggttaaatcaaattgttggaactgactccagcggaggacaaccgtctccttctggatctctattaaataaagtttcagtgcttgaaggagaagtttcagttttaaacaataatgttcaaaatatacaagttgaaataggaaataatagaacaggaattaaaggtcaagttattgaacttacttcacttataaatggaaataatcctgacggatcaactgttgaagaacgaggattaactaattctgtaaaaaagaatgaaaccaacattgcggcagtcacacatgaagtaaatacagctaaagacaatatatcctctttacagagcagcgttcaagctctacaagaagcaggttatattcctgaagctccaaaagatggccaagcttacgttcgtaaagacggcgaatgggtactactttctacctttttatcaccagcataacatggggccgcaaggccccaaaggattttaaatgtcaggatataattctcagaatccaaaggaactcaaagatgtcattctaagacgtttaggggctccaattattaatgttgagttaacacccgatcaaatttatgattgtatccagcgtgccctagaattatacggtgaataccattttgatggacttaacaaaggttttcatgtattttatgtaggagatgacgaagaaaaatataaaaccggagtcttcgatttaagaggttccaacgtatttgcagtaacccgcattttacgcacaaatattgggtcaataacatctatggatggaaatgctacatatccgtggtttactgactttcttttaggaatggctggtattaatggcggaatgggaacgtcttgtaatagattttatggaccaaatgcctttggagctgatttaggatattttactcaacttaccagttatatgggaatgatgcaagatatgctctctcctattccagacttttggtttaattcagcaaatgaacagctcaaagtcatgggaaacttccaaaaatatgatttaattatcgtagaaagctggactaaatcatacattgatactaataaaatggttggaaatacagtaggatatggaacagtcggtccacaagatagctggtcattatctgaacgatataataacccagaccacaatttagttggtcgcgttattggtcaagattcgaatgttaaacagggtgcttataataatcgttgggtgaaagactacgctacagctttagctaaagaattgaatggtcaaattttagcacgccaccaaggtatgatgcttcctggcggtgttacgattgatggacaacgcttaatagaagaagctcgattagaaaaagaagcattacgtgaagaattatacttgctcgatcctccatttggaattttggtaggttaatatggctacttatgataaaaatctttttgctaaattggaaaaccgcactggttattctcagaccaatgaaactgaaatactaaatccttatgtaaatttcaatcattataaaaacagtcaaatattagctgatgtattagtagctgaaagcattcaaatgcgaggtgtagaatgctattatgttccaagagagtatgtttcccctgatttgatatttggcgaagacttaaaaaataaatttactaaagcttggaaattcgctgcatatttaaattcatttgaaggatatgaaggagctaaatcgttctttagtaactttggtatgcaagtacaggatgaagttactttgtccattaatccaaacttgtttaaacaccaagttaatggaaaagaaccgaaagaaggcgatttgatatattttcctatggataacagcttatttgaaattaactgggttgaaccatatgatccattttatcaattaggtcaaaacgctattcgtaaaattacagcaggtaaattcatttattctggagaagaaattaatccagttctacagaaaaatgaaggaattaacattccagaatttagtgaattagaattaaatcctgttcgcaatcttaatggcattcatgatattaatattgatcaatatgctgaagtagatcaaattaattctgaagctaaagaatatgttgaaccttatgttgttgtcaataacagaggcaaatcttttgaatctagcccatttgataatgatttcatggattaataaatattataaactaattaaagcccagattaggagaaatcatgtttggttatttttataattcgtcttttagacgatatgctaccttgatgggcgatttgttttcaaatatccaaatcaaacgtcagttagaatctggtgataagtttatacgtgttcctattacgtatgcatcaaaggaacactttatgatgaaattgaataaatggacatcgataaattcacaagaagatgtggccaaggttgaaactattctacctcgtataaatttgcatttagttgattttagctataatgctccatttaaaacaaacattttaaatcagaatttactgcaaaaaggcgcaacttctgtagtatcacagtataatccatctcctattaaaatgatttatgaattgagtatctttactcgttacgaagacgatatgtttcaaatagttgaacagattcttccatattttcaacctcattttaatacaactatgtacgaacagtttggaaatgatattccatttaaaagggatattaaaattgtactgatgtctgctgctatagatgaagctatagatggagataatttatctcgtcgtagaattgaatggtcactaacatttgaagtaaatgggtggatgtatcctccagtagatgatgcagaaggattaattcgtactacttatacagattttcacgccaatacaagagatttgcctgatggcgaaggtgtttttgaatctgtcgataatgaagttgttcctcgagatattaacccagaagactgggatggaacagtaaaacaaactttcactagcaatgtaaatagaccaacaccgccagaacctcctggcccaagaacatagaggttattatggaaggtcttgatataaacaaacttttagatatttctgacctccccggaattgacggggaggaaattaaagtatatgaacctctgcaattagtagaagttaaaagcaatcctcaaaaccgtactccagacttagaagatgattatggagtagttcgtcgaaatatgcattttcaacaacaaatgctaatggacgcggccaagatttttcttgagacagcaaagaatgctgattctcctcgtcacatggaagtatttgcaactcttatggggcaaatgactacgacgaacagagaaatactgaagcttcataaagatatgaaagatattacatctgagcaggttggcactaaaggcgctgttcctacaggtcaaatgaatattcagaacgcgacagtattcatgggttcaccaacagaattaatggacgaaattggtgatgcttacgaggctcaagaagctcgtgagaaggtgataaatggaacaaccgattaatgcattaaatgatttccatccattaaatgaagctggaaaaattttaataaaacacccaagcttagcagaaagaaaagatgaagatggaattcattggataaaatcacagtgggatggaaaatggtatcctgaaaaattcagtgattatcttcgtttacacaaaatagtaaaaatcccaaataattctgataagcctgaattatttcaaacttataaagataagaataataaaagatctcggtatatgggtcttcctaacttaaaacgagctaatattaaaacacaatggactcgtgaaatggttgaggaatggaaaaaatgccgagatgatattgtatattttgcagaaacatactgcgccattactcatatcgactatggtgtcataaaggttcaattacgtgactatcagcgtgatatgctcaaaataatgtcatctaaacgtatgactgtttgtaatctatcacgtcagcttggtaaaacaactgtagtagctatttttcttgcacactttgtatgttttaacaaggataaagctgtaggtattcttgcgcacaaaggttcaatgtctgcggaagttttagatcgtactaagcaagcaattgaactgcttcctgactttttacagcctggtatagttgaatggaataagggttcaattgaactagataatggttcttcaattggcgcttatgcttcctctcctgacgcagttcgtggtaactcattcgcaatgatttatattgacgaatgtgcatttattccaaacttccatgattcctggcttgctattcaaccagtaatttcatctggtcgtcgttcgaaaattattattactacgactcctaatggattaaatcatttttatgatatttggactgctgccgttgaaggtaaatcagggtttgaaccatacaccgctatttggaattcagttaaggaacgtctttataacgatgaagatatttttgacgatggatggcaatggagcatacaaaccattaatggttctactttagcacaattccgtcaagaacataccgcagcgtttgaagggacttctggtacattaatttcaggaatgaaattagctgttatggatttcattgaagtaactccagatgatcatggttttcatcgatttaaaagccctgaaccagatagaaaatatattgcaactctagactgttcagaaggtcgtgggcaagattaccacgctttacatattattgatgttaccgatgatgtgtgggaacaagttggtgttttacactcaaacactatttctcatttaattctacctgacatcgttatgcgttatttagtagaatataatgaatgcccagtttatattgaattaaatagtactggtgtgtcagttgcgaaatcactttacatggatttagaatacgaaggcgttatttgcgattcatatactgatttaggaatgaagcaaactaaacgaacgaaagcagtcggatgctctacattaaaagaccttattgaaaaagataagcttattattcatcaccgtgcaactattcaagaatttagaacgtttagtgaaaaaggtgtgtcttgggcggctgaagaaggttatcatgacgatttagtaatgtctttagtaatttttggatggttatcaacacaatcaaaatttattgattatgccgacaaagatgacatgcgattagcatctgaagtgttttcaaaagagcttcaagatatgggggatgaatacgctccagttatatttgttgattcggttcattctgctgagtatgttccagtatctcatggtatgtcaatggtataaatatattaaagcatattaaagaggattaaaaatgactttattatctccgggcattgagctcaaagaaactacggttcaaagcaccgtggttaataactctactggtacagcagctttggccggtaaattccagtggggtcctgcttttcagattaaacaggttacaaacgaagtagatttagttaatacttttggtcaacctacagctgaaactgctgactattttatgtctgcaatgaatttcttacaatatggaaatgatttgcgagttgtgcgcgctgtcgatagagataccgctaaaaactcatctccgattgctggtaatattgaatacacaatttctaccccaggtagtaactatgcagttggagataaaatcacggtcaaatatgtttcagatgatattgaaactgaaggtaaaattaccgaagtagacgcagatggaaaaattaagaaaattaatattcctactgcaaaaattatcgctaaagcgaaagaagtcggtgaatatccagcactaggttctaactggactgcagaaatttcttcgtcttcctctggtttagctgcagtaataactcttggaaaaattattactgattctggtattttattagctgaaattgaaaatgctgaagctgctatgacagctgttgactttcaagcaagtctcgaaaaatatggaattccaggagtagtagctctttatccaggcgaattaggcgataaaattgaaattgaaatcgtatctaaagctgactacgcaaaaggagcttctgcattactcccaatttatccgggcggtggtactcgtgcatctactgccaaagcagtgtttggatatggaccgcaaactgattcacagtacgctattatagttcgtcgcaatgatgctattgttcaaagcgttgttctttcaactaagcgtggtgaaaaagatatttatgatagtaacatctatatcgatgactttttcgcaaaaggcggctcagaatatatttttgcaactgcacaaaactggccagaaggcttctctggaattttaactctgtctggtggattatcatcaaatgctgaagtaacagcaggagatttaatggaagcttgggacttctttgctgaccgtgaatctgttgatgttcaactgtttattgcgggttcttgtgccggtgaatctttagaaacagcatctactgtccaaaaacacgtcgtttcaattggggatgctcgccaagattgcttagtattgtgctctcctccgcgtgaaactgtggttggaattcctgtaactcgtgcagtagataatttagttaactggagaactgcggcaggttcatacactgataataactttaatatcagttcaacctatgcagcaattgatggtaactataagtatcagtatgacaaatataatgatgtaaatcgttgggttccattagcagctgacattgctggtttatgcgcgagaactgataacgtttctcagacttggatgtctccagctggttataatcgtggtcagattcttaacgttattaaacttgctattgaaactcgccaagctcagcgcgaccgtttatatcaagaagctatcaacccagtaactggtacaggtggtgatggttacgtattgtatggtgataaaacagctacttctgttccttctccatttgatcgtattaacgttcgtcgtctgtttaatatgttgaaaacgaatatcggacgtagttcaaaatatcgtttgttcgaattaaacaacgcgtttactcgttcatcattccgcacagaaactgcccaatacttacagggaattaaagctctcggtggaatttatgaatatcgtgtagtttgcgatacaacaaataacactccgtcagtaattgatagaaatgagtttgttgcaacattctacattcaaccggctcgtagtataaattatatccaacttaatttcgtcgcaactgctaccggtgcagattttgatgagttaactggtcttgcaggttaattgattatggggcttcggcccctattctcgaggaaacaagtgattatttctaagtttgttacaataaaaccaagaaatcattcaaaaatgtggtcgacaattctgggatataaagtatcatatcatgatacagtatctgttccaatagaattaatgccaaagaatagtaataaaatagttgacgctaaatgtgatttgtgtggtactaaatttagtagaagcattcaacttttaaatagaacacccacacatgcatgtagaaaatgtagcattaaacaagttgctattaaaaattcggaagttcaatctggaataagcagaccatggcaaagaggtgataaacatcctcgatggactggcaaaagaaaagagtttgcattatatgctagtagagttcattctataactaagtcagctaaaataagaaaaatctggtcaaaatggccgaatgctgataaaataggaatgtgcggcgtagaaggtgcttatcaactcgatcataaagtatctatcaaatatggatttgataatttaattccgccggaaattatagcaagtgtaaaaaatttagaaataatcacttgggaatctaaccgagaaaagtcaaaaagaaatagcgtagatctttgggatttactagaatgattctaaaggcctgtttcggcaggccatataaatacactatatccttaattctttaattctatatgccctaggttaaacatagggatataaatactacagaggctaatatgtttgtagatgatgtaacacgagcgtttgaatctggtgattttgctcgacctaacttattccaagtagaaatttcttatcttggacaaaattttacattccaatgtaaagccactgctttaccagctggtattgtagaaaaaattccagtcggatttatgaaccgtaaaattaacgtagcaggcgatcgtacattcgatgactggactgttacagtaatgaacgatgaagctcatgatgctcgccagaagtttgttgattggcaaagcattgctgctggtcaaggaaacgaaattactggtggaaaacctgcagagtataaaaagagcgctattgttcgtcaatatgctcgtgacgctaaaacagtaacaaaagaaattgaaattaaaggtctgtggcctactaacgtgggtgaacttcaattagattgggattcaaacaatgaaatccaaacatttgaagtaactcttgctctcgattattgggaataaaatgaatggggagaaatccccatcctgcttaaagcagagaagtccattataaatataactataattcccatttggagaatacaatgaaatttaatgtattaagtttgtttgctccatgggctaaaatggacgaacgaaattttaaagaccaagaaaaagaagatcttgtttccattacagccccaaagcttgatgatggagcaagagaatttgaagtaagctcgaatgaagctgcttctccttataatgctgcattccaaacaatttttggttcatatgaaccaggaatgaaaactactcgtgagcttattgatacatatcgtaatctcatgaataactatgaagtagataatgcagtttcagaaatcgtttcagatgctatcgtctacgaagatgatactgaagtcgtagcgttaaatttggataaatctaaatttagtccaaaaattaaaaatatgatgttagatgaatttagtgatgtattaaatcatctatcgtttcaacgaaaaggttctgatcattttagacgttggtatgttgattcaagaattttctttcataaaatcattgatccaaaacgtccaaaagaaggcataaaagaattacgtagattagaccctcgccaagttcagtatgttcgcgaaattataacagaaactgaagctggcacaaaaatagttaaaggttacaaagaatattttatatatgatactgcccatgagtcatatgcatgtgatggtagaatgtatgaagctggcacaaaaataaaaattccaaaagctgctgttgtttatgcccattctggattagtcgattgctgtggcaaaaatatcatcgggtatttacatcgtgctgttaaacctgctaaccaattaaaattattagaagatgctgtagtcatttatcgcattactcgtgctcctgaccgtcgtgtttggtatgtagacacaggtaatatgcctgctcgtaaagctgctgagcacatgcaacatgttatgaacacgatgaaaaaccgtgtagtatatgatgcatcaacaggtaaaataaaaaatcaacaacataatatgtctatgaccgaagactattggttgcagcgccgtgatggtaaagctgtgacagaagttgatactcttcctggtgctgataatactggcaatatggaagatattcgttggtttagacaagctctttatatggcattacgtgttcctctttcacgcattccacaagaccaacaaggcggtgtgatgtttgattctggaactagcattacacgtgatgaattaacgtttgctaaatttattcgtgagttacagcacaagtttgaagaagttttcctagatccacttaaaacaaatcttttgcttaaaggtataatcacagaagatgagtggaatgatgaaataaataatattaagatagaatttcatcgggatagctactttgctgagctcaaagaagcagaaattttggaacgaagaattaatatgctaaccatggcagaaccatttattggtaaatatatttctcacagaactgctatgaaagatattttgcagatgactgatgaagaaatagaacaagaagccaagcaaattgaagaagagtctaaagaggctcgtttccaagaccccgaccaagaacaagaggatttttaatggaaggtttaattgaagctattaaatcaaacgacctcgtagccgctcgtaaattatttgctgaagccatggctgcaagaacgactgatttaattaaagaagaaaaaatcgctatcgctcgtaatttcttaatcgaaggtgaagaacctgatgacgaggatgatgacgaagacgaagatagtgatgataaagacgacaaaaaagacaaagactctgacgaagacgaggatgatgaataatgcttctgatccctgaaactcatgaattagttctcgagaatgtcgaagcacttattcctgaagcacagggtcgctttgacgaattgtcttctgctttaaataaagacgatataaatacaattgtcgagaatatgcttgatgatgaaactgatttagcggttgcattagcttctattaatgaaaatatgccgttaaatgaatttatcgttaaacatgtttctgcccgtggtgaaattactcgcactaaagatcgcaaaacccgcgaacgtaatgcatttcaaaccactgggctgtctaaagcaaaacgtagacaaattgctcgtaaagctaccaaaacgaagattgccaatccagcaggtcaatctcgtgctcagcgtaagcgtaaaaaagctcttaaacgccgtaaagcattaggattaagctaatgaatgaaccccaattactaattgaaacttggggtcaacctggcgaaattattgatggcgtgccaatgcttgaatctcatgatggaaaagacttaggtttaaaacctggtttatacatcgaaggaatattcatgcaagcggaagtcgtcaatagaaataaacgtctttatccaaaacgtatattagaaaaagcggtaaaagactatattaatgagcaagttttaactaaacaagctctcggagaattaaatcatcctccacgcgctaatgttgacccgatgcaagccgctatcattatagaagatatgtggtggaaaggaaatgacgtatacggacgagctcgtgttattgaaggtgaccatggtcctggagataaattagcagctaatattcgtgccggatggattccaggagtttcttctcgtggattaggttcattgactgacacgaataaaggttatcgtatcgtaaacgaaggattcaaattaactgtaggtgttgatgcagtatggggtccaagtgctccagatgcatgggtaactcctaaggaaattaccgaatcacagacggcggaagccgatacaagtgccgatgacgcctatatggctctcgcagaggccatgaaaaaagcgttataaatattattatctaaacaacaggactacaaaatgcttaaagaacaactgattgccgaagcgcagaaaattgatgcttccgttgctcttgatagtattttcgaatcagttaatatttctccggaagcaaaagaaactttcggcactgtattcgaagctaccgtcaagcagcacgccgttaaattagctgaatctcatatcgctaaaattgctgaaaaagcagaagaagaagtagaaaaaaataaagaagaagcagaagaaaaagctgagaagaaaatcgctgagcaagcttctaaattcattgaccatcttgcaaaagaatggctcgctgaaaataaattagcagtagataaaggcatcaaagccgaactgtttgaatccatgcttggtggattaaaagagctctttgttgaacacaacgttgttgttccagaagaatcagttgatgttgtagctgaaatggaagaagagctgcaagaacataaagaagaatcagctcgtctgttcgaagaactcaataagcgtgacgcatatatcaattatgtgcagcgtgaagtggcattgagcgaaagtactaaagatctgactgagtctcaaaaagaaaaagtctctgctctggtcgaaggtatggattattcagatgcattctcaagtaaattgagtgcaatcgtagaaatggtgaagaaatctaataaagatgaaagcactattactgagagtataaatactcctgatactgaagcagccggactgaatttcgtcactgaagctgtagaagataaagctgcacctggtgcagaagatattgtaagtgtatatgcgaaagtcgcatctcgtttctaattttaaaggttaacacaaatgactatcaaaactaaagctgaacttttgaacaaatggaagccattactggaaggtgaaggtttaccggaaattgctaatagcaaacaagcgattatcgctaaaatctttgaaaaccaggaaaaagatttccagacagctccagagtacaaagacgaaaaaatcgctcaggcgttcggttctttcttaacagaagctgaaatcggtggtgaccacggttacaacgctactaacatcgctgctggtcagacttctggcgcagtaactcagattggcccagctgttatgggtatggtacgtcgtgctattcctaacctgattgctttcgatatttgcggtgttcagccgatgaacagcccgactggccaggtattcgcactgcgcgcagtatatggtaaagacccaatcgcttccggtgctaaagaagcattccacccaatgtatggtccagatgcaatgttctctggtcagggtgctgctaagaaattcgctgctttgaaagcaagtgatactcttgaagtcggaactatttacactcacttcttccaggaaactggtacagtatatctgcaagctacagcagctaaacaaattgattcaggcgcatctgacgcagacaaattagatgctgaaattaagaaacaaatggaagctggtgtactggtagaaatcgctgaaggtatggctacttctatcgctgaacttcaagaaggttttaacggttctaccgataacccgtggaatgaaatgggcttccgtatcgataaacaagttatcgaagctaaatctcgtcagctgaaagctgcttactctattgaattagcacaagacctccgcgctgttcacggtatggatgctgatgctgaactgtctggtattctggctacagaaattatgctggaaatcaaccgtgaagttgttgattggattaactactccgctcaggttggtaaatctggtatgaccctgactccgggttctaaagctggtgtatttgacttccaggacccaatcgatattcgtggtgctcgctgggcaggtgaatcctttaaagctctgttgttccagattgacaaagaagcagttgaaattgctcgtcagactggtcgcggcgaaggtaacttcattatcgcttcccgtaacgtagttaacgttctggcttcagttgataccggcatttcttatgctgcacaaggtctggctactggctttaacactgatactaccaagtcagtatttgctggtgttctgggtggtaaataccgtgtatatatcgaccagtatgctaaacaggattatttcaccgtaggttataaaggtccgaacgaaatggatgctggtatttactatgctccatatgtagctctgactccgctgcgtggttctgatccgaagaacttccaaccggtaatgggattcaaaactcgttacggtatcggtatcaacccatttgcagaatccgctgctcaggctccggcttctcgcatccagagcggtatgccttctattctgaatagccttggtaaaaacgcttactttagacgtgtatatgttaaaggtatctaatctttgacgatttaagggaccttcgggtccctttagttgtttttatggtataaataaatcatataaaccaaaaggaaagcgcaatggctaaaatcaacgaacttctgcgcgaatcaaccacaacgaatagcaactcaatcggtcgcccaaatctcgttgctttgactcgcgctaccactaaattaatatattctgacattgtagcaacgcaaagaactaatcaacctgttgctgctttttatggtatcaaataccttaacccggataacgaatttacatttaaaactggtgctacttacgctggcgaagctgggtatgtagaccgagaacaaatcacagaattaacagaagagtctaaattaactctcaataaaggcgatttattcaaatataataatatcgtttataaagtattagaagatacaccatttgctgatattgaagaaagcgatttagaattagctcttcagattgcaatcgttcttttaaaggttcgtctattttctgatgctgcagtaacaagcaaatttgaaaactctgatagcgaaattgcggatgctagattccagattaataaatggcaaaccgcagttaaatctcgtaaacttaaaactggcatcacagttgaattagcacaagatttagaagcaaacggattcgatgctcctaatttcttggaagatttgcttgcaactgaaatggcggatgaaatcaataaagatattctgcagtctttgattacagtatcaaaacgctataaagttacaggaattactgatactggattcattgatttgagttatgcatctgcacctgaagctggtcgttcattataccgaatggtgtgtgaaatggtttcacatatccagaaagaatcaacttatacagcaacgttctgtgttgcttcagctcgtgccgctgcgattcttgctgcatcaggttggttaaaacataaaccagaagatgacaaatatctttcacaaaatgcctacgggttcttagctaatggtttaccgctttattgcgataccaacagtccattagattatgtaatcgttggcgtagtagaaaatattggtgaaaaagaaattgttggatcaattttctatgctccgtatacagaaggtcttgacttagatgaccctgaacatgtaggtgcatttaaagttgtagttgatccagaaagtttgcagccatctatcggtttattagttagatatgctttatctgcaaatccttacactgtagcaaaagatgaaaaagaagcaagagtaattgatggtggagatatggataaaatggcgggtcgttcagatttgtctgttttattaggtgttaagctaccaaaaattatcattgatgaataaaacaaagggaccgaaaggtccctttttatttaacttaccaattcaatccaagccggacgaagtacatcttgtaccattttaactaattccttcttaatcaaagaaggattatccgcttgagttagagtaataccttcacgagaagtttcttccaaaatatcttgaacagttagccccatcacctttccaaaatcttttggaccaatttcaccaattttagaaataacgttatttactcggttcagtgtaacgtaacaagctaaaattccaaccaatttgttatcagcttctgacagttcaactttagctttaataggcttatcagactttttcttttcactaaatttagagttcttgcatttgatagctacgcgattgccattaggcatccaagaaggataacaaggtttcaatacatatccttcagcggtaaatacttcgccttttacttcagcattccaaacgcatttatttgcatcaactaatccagcatggtctaccgtaaaattataatcctggacgacagaatctaaatcatttggcaatttaataagttcttcaaatttaccgcgacctaaaagtggagccattttaaatttaaatgtattgcagaatgattccatcatataatcatcgacataagtcacatcaccactttctgtagtaacaataatgtcaaatacataaaaatctttatcgccataatcgacattcttctgaatgccaggtccagcgaattcgccaaaaacttgataagatacaaccgctgaagtttccataatatcttgtactgctttaatagaatcttcgtaattctttagaataatttcatacccaaagaaatcttcagcaggaagaatcggtccagtacgtttagcgcaagttactttatcacgctcaataatcaatgagaaatttgtgccgtgaatcttttcacgagctacccactccccaccagtcaatcccaagctataaagtttttcaataaatttagagttgtaatgattttcaagactgctatactttttaaacataattaatcctcaaaatgtaatttctaaccaatcaccatcacgctgatcactattgactttaaagctgaatccttcttttctcagccaatcaccaatttcttcagtaatcaatttatcacgagcaatacaataataactaaaatgtgttttaccttgttcagctgctttattagcaagttccgaaaaatctttaataaaacactctagcttaaactgtttacttttaagtgctttttcgcgcaattgattagcaaaagattcattttcataaagatcatactgttccatttttcacctttttattgatatgtctttttctatagacgactttttctcgagtttcaaatttatttttagcagtcatagctcgagcccataatacagccacttcttttgcctgtaagtttaattcacgagcaatttcaatgaatgactttccagactcatgaagagtaaacaccacaacctcagttctcataatcaatctcatgttatcgagttgatgccattatatacatcattttctgagtatgttttgtgtgctttcaaaatgaagaaaggggccgaagccccttatgattatgattatggataggtatagatgataccagtttctaaagcagttttatgaatgatgtatccattgcgtgattcttgaacatcaacttctggatagtctttcatcatcttctgaagagtgtaacgatgcaggtagtatttactgtctggatcttcagttttccaatctttaccttcttcggtcattttttggatttcatccataacccaccaaccgcaccagatataagctgaagtacgatgtggaagaggatgaacataaggcaattcaccttctggttctggagcaactttatcagttacctgaacttgaccttctgctgtaatagttttgctatcgtaatcagttgcagtaacgacagcagtaacttcaatagtttgacttccaacagatgaggtatcgacagtatatacgttagttgacccttctacaggagaagaatctttcttccatgagtaagtaatttgtgcttcttctggagcacccgtaacattagccgtaaatgtagccgaagcatcttgctgaacattaatagaaggaggagtcaatgtaacctgtggattcattgtcttcttattaactgtcaatgatacttcattagaagtaactgtttttgcgtcataatctgttgctgttacttgcgctacgcatttaattctttttactccacttgtagttggagtatagctaaatgtagcagaagtcgcttcaccaatttgagaatcatctacataccactgatacgtagcagatgccccatcaggttgagaagctaaggcagcagtaaattcaacggctgttccaatcactccagctggaggactatcaggagttactgccaaggtagtcgtctgcgtctttttattaacagtcaatgatacttcattagaagtaacgcttagtgcatcataatctgccgcagttacttgagctacacacttgatttttttaactccgcttgtgtcaggagtgtaattgaatgtagcgtcagttgcttcgtctacaggagaaccgtcaacgtgccattgatacgtagcgtttgcacctgatggctgtgaagctaaggcagcggtaaattcaattggagttccaatcactccagcatcagggctaccaggagttacagctaaagtagttgtttgtgtcttattttgaactgtgatagttgtagtagcttctgctgtttcagcatcagtatctggaactgtatttgttgcaactactttaatagtcttttgtccagcaggtccttttaatacataatcaaaagttgcttcagctccatcttgtggagcatcatctacagtccaagcatatgtaatagttccgcctccagtttcaccactgggtgtagcagtaaactgcttagtttcatcaataacccctgtcggtgttttaggagttatatcaactgtaaaagtcataagttatccttattttaatgttacgaaagaagagttgcgtgtttcacgaattaaaactgatccgtcacggttaatgtaataaattaagctaaataaagtttggtgtgctgacgcatgttcaaaactagttgggtgagatttccaatcaggagtttcagcaatccattgataaatccaccaaggaacagtacagaatcctggattttttccaatcaactgaagattcgggctaaagttttccggaagagtaaatacagacagcttttcagattcaataatctcagctacagcctgctcgaatttttcttcaacaaaaggagtatcttcaatcaaaacatcggtattttcaggaattttatccgtttctactacttcaattttaatgtcagatttaaccggagaatcaatcagaagtgctgcttctggattgacttcttcatcgtcatattttaatccctctgcagcatcagcagcatcaattaagtctttaatagataacccatcagtctctggcataggttcactagcgagcttctggagggcttcttcaatatcaacaacgatattatcaaaagatttattctttttgacctttataccaaactgttcagcatattcagctaatttagctttagcttctttgttatcatcaagagccttcagctctgcaatataatctttatctatcataatatttcctcagtataaatatagatatatttattactcggaaaatagtatgtaccactttgtatatgaaacaacaaatctaataaatggtaaaaagtatataggaaaacactctactgatgacttgaatgatggttaccttggttccggtaaggcaattcagcaggctataaagaaatatggtgaaaacaatttctctagaacaatactaaaagagtttaaaacttccgaagaagcgtacatgtatgaagaagaaattataactcctgaaataataaaaagcaaaaattattataatatgaaacctggtggaattggtggaattgttatgactacagaggttatagcaaagatgaaagaatcttccgctaagagatttgaaaactcaccgggcacggtattaggtacaacttgttacactaatggaactaaaaatatttttattaaacctggagaacttgttccagaaggatttgtaaaagggatggttcatcctaatagaaagtccagaaaaggatgtaaagtcaaaccgactaccacaggaactttttgggtcaataatggtgcaataaataaattaatacaaccagacggtattattcccgacggatttattaaaggtcgtctcatgaaaagagattctaaaggcaaatttagtaaggcataattatggatattaaagtacattttcacgacttcagtcatgtacgcatcgattgtgaagagagcacgttccacgaattaagagatttcttttcgtttgaggccgatggatatagatttaaccctcgcttcagatatggcaactgggatggacgaatccgtcttttagattataatcgccttcttccattcggtttagtcggacaaattaaaaagttctgcgataactttggctataaagcctggattgacccacagattaacgaaaaagaagaattatcaagaaaagattttgatgaatggctttctaaattagaaatctattcaggaaataaaagaattgaaccgcattggtatcaaaaagatgcagtgttcgaaggattagttaatcgtcgtagaattcttaatcttccaacatccgcaggtaaatctttaattcaagctttgcttgctcggtattatttggaaaattatgaaggcaaaattcttattattgttccaacaactgctctgacaactcagatggctgatgactttgttgactatcgtttattcagtcatgcaatgataaagaaaatcggtggaggagcatcaaaagatgataaatataaaaatgatgcaccagtcgttgttggtacatggcaaactgtagtaaaacaaccgaaagaatggttctcacagtttggaatgatgatgaatgatgaatgtcatcttgctacaggaaaaagtatttcatctatcatatcaggtttaaataactgcatgttcaaattcggtttgtctggttcattacgtgatggcaaagccaatatcatgcagtatgttggaatgttcggtgaaatatttaagccagtaacgacttctaagttaatggaagatggacaagtaactgagctaaaaattaatagtatttttcttcgctatcccgatgagttcactactaaattaaagggaaaaacttatcaagaagaaataaaaattattacggggcttagtaaaagaaataaatggatcgctaaattggctattaagcttgcacaaaaagatgaaaacgcttttgtcatgtttaaacatgtatcgcatggtaaagctattttcgatttaattaaaaatgaatacgataaagtttattacgtatcaggggaagttgataccgaaacccgcaatataatgaaaaccttagctgaaaacggtaaaggaataattatagtagctagttatggtgtattttctactggtatttcagttaaaaatctgcatcacgttgttttagcacacggtgttaaatctaaaattattgtattgcaaacaataggtcgcgtattacgtaaacatggttctaaaacaatcgcaacagtctgggacctcatagatgactgtggtgtcaagccaaaatctgctaatactaaaaagaaatatgttcacttgaactatcttttaaaacacggcattgatcgtattcagcgctacgcagatgaaaaatttaattacgtaatgaaaacagttaatttataagggcttcggccctttggagaaaaagatgttactagaatttaaacaatttctttatgaagcttctattgatgaatttatgggtaaaattgcctcttgtcaaacattagaaggtttagaagaacttgaagcttattataagaaaagagttaaagaaactgaattaaaagatactgatgacatctcagtcagagatgctttggcaggaaaaagagctgaattagaagattcagacgatgaagtagaagaaagcttttaaattaaaaaaggcccaaccaaaaaggaagggccaaaactatagactaaaggtcacactatagcaaaagttgcgtttcatttaattgttcttccgaactttctgaaactggtagttctttaatgtaattatagcaaggcccaggatgtacaggacctttgtctgtttcaacaaccaatgcagaatcgattggagttttacagacaacacaaatcttatctgacatgattgtctcctctgaattatatatctatttatacaactctcatatgcatatcaatgcccatatctttagaataaaaatattcatcaagatatccggcaaattttcctttaatataaagaacatcttcaccgcccgggtggtcggccaggatacgaatatcctgacgcttgagattatactttttcattaagaattgaatttccgtttcgaattcttcttcataattaaaagcatcatcaatgctatatttcattattttccagcctcaaatgctcgcatgtcttgaatatgcttaatagcaaatccgcgtgatttaatagcatcaagagctccgctacagaaatccaataaaattccccaatattgtaatgaagtatcaacttttaaaacatccttatcagctgatagaactgtcttcatttctgatttctcgtaacgatccatactaaattcatcaccatctcctcgtcccgagtagtagtctaatttagctttaagagcaacttttttctgtgcttcaattctaagcatttcctttttaatacttgaatgcttattaagccatttactatataacatcacattattagctgcttcatactgtaatttagtcgaatctataaatacatctttcttcaattcttcttgaagatcttctaatctcatattgttctctattcaattgttattggatggacttagattcattataccacgtttatacgtgaagcattatactctattactggaagccagttgtagttttatttgctcaatatcatcagggttatcgatgactgaaaagcgtatttctactatcaaagtataatcatcataaaccggtattacattaactgctaatttatcaatacgtggctcatagtttcttactgcgctttcgatattacgctcaaccgtgtcagcagtaagaggagtcatattctcaaaaagttggtcagataaatcgcatccaaattcagggtcaaacggtcttgaaccttttcttgttgtaataattcctaaaagactatttttaattgaccttaatccaagtgatcttgaaacgtctttgttccaatccattttcatctctgggtcaatatcagaataaagcttattaatatttgccattacaatagctcaaagaattctttgagtcctcttattacatgagcgtgagtttttccacactctggacatttaattggaacagccaaataaacagtaggctttaaaagcatatcttttatagctacaatatctgactctgcgatgatagaatataaatcttccagttctttttcatttaagtcttcaactggaatgctttcaccgttagcatgaatcgtttctatacatgatactatcatgtgggctatatttttatcatcaaaaattttagggtaatggaatttaattttaatgtcacccagtgtataccagaggtcttctggtgcatctatttgtgtatgtaatagatttatatgggttggtatttcagttccacaggtgcacttccaggagttttcgtgattaacttctccaagagaatgcgcccataaatgaatcagtaatagttctgattcttggcggtttaaatcttttgcatttgtacagtctttgattagctttttaacaatctcttctactgaaccattctttttagcagtaataagttctagatattctttaagagtaaatgcgcgacagttgattattttagaaccaactctcacatcaaatttgtattcatacatatttagctcctttatttatcatatttataaatagaataaaaggagcatctatggcaaacattattcgttgtaaattaccagatggtgttcatcgttttaaaccatttacggtagaagattatcgagattttttgttagttcgaaacgatatagaacatcggtcaccacaagaacaaaaagaagtaattgctgatttaattgctgattattttggagactatccaaagacttggcaaccatttatatttttgcaggtatttgtaggttcaataggtaaaactaaagtaccggtcacatttgtatgtccaaaatgtaaaaaagaaaagacagttccatttgaaatatatcaaaaagaattaaaggaacctgtttttgatgtagctaatgttaaaattaaattaaagtttccttctgagttttatgaaaataaagcaaagatgattactgaaaatattcattctgttcaagtagatgaaatatggtatgattggaaggaaattagcgagtccagtcaaatagaactagttgacgccatcgagatagaaacattagaaaaaattctcgatgcaatgaatcctattaatttaacattgcacatgtcgtgttgtgataagtacattaaaaaatacactgatatagtagatgtgtttaagctattagttaatccagatgagatatttactttttatcaaattaatcacacgcttgtaaaaagtaattatagcttaaattcaataatgaaaatgattcctgccgagcgcggattcgtattaaaactgattgagaaggataaacatcaatgagtatgttacaacgtcctggatatccaaatctcagcgttaaattatttgagagttatgacgcttggagtaataatagatttgttgaattagctgctactattaccacattaactatgcgtgactctctttatggtcgaaatgaaggaatgctacaattttatgattctaaaaacatccatacaaaaatggatggaaatgaaataattcagatttctgtagctaatgcaaatgatattaataatgttaaaacacgaatttatggatgtaagcatttttccgtgtcagtagattcaaaaggcgataacatcattgctattgaattgggaactattcattctatagaaaatcttaaatttggtagaccatttttccctgatgcaggtgaatctataaaagaaatgcttggtgtcatttatcaagaccgcacattattaactccagcaataaatgctataaatgcttatgttcctgatattccatggactagtacatttgaaaattatttgtcctatgtaagagaagttgctctagcggtaggaagcgataagttcgtatttgtatggcaagacatcatgggagttaacatgatggactatgatatgatgataaatcaagaaccatatccaatgattgtaggtgagccaactttaataggtcaattcgtccaagaattgaaatatccattagcatatgattttgtttggttgactaaatcaaacccgcataaacgtgatccaatgaaaaatgctactatctatgctcattcgtttttagattcttcactgccaatgattactacaggaaagggtgaaaactctattgtagtgtcaaggtcaggtgcttattctgaaatgacttatagaaatggctatgaagaagctattcgtcttcaaactatggcgcaatatgatggctatgctaaatgttctactgtcggtaattttaacttgactcctggtgttaaaattatttttaatgatagtaaaaaccaatttaaaacagaattttacgttgatgaagttatccatgaattatcaaataataattcagtaactcatctatatatgttcactaatgcaacgaaactggaaacaatagacccagttaaggttaaaaatgaatttaaatctgatactaccactgaagaaagtagttcttccaataagtaataaagaagtttctattcctaaaatgggtcttaaacattataacattttaaaagatgttaaaggccctgatgaaaatttaaaacttcttattgattctatttgtccgaatttgtcaccggcagaagttgatttcgtttctattcatttattggaatttaatggaaagattaaatctcgtaaagaaatagatggctatacttatgacattaatgatgtttatgtatgccaaagattagaatttcaataccaaggaaatacattttattttagacctcctggaaaatttgagcaatttttgacagtaagcgatatgttatctaaatgcttgcttaaggtcaatgatgaagttaaagaaattaattttcttgagatgccagcatttgtattaaaatgggcaaatgatatttctacaactttagcaattcctggccctaatggtccaataactggaattggcaatattattggattatttgaatgaaaaagccacaagaaatgcaaacgatgcgtagaaaagttatttcagataataaaccaacacaggaagcggctaaatccgcttctaacactttatctgggcttaatgacatttctacaaaattggatgatgctcaagctgcttctgaattaatagctcaaaccgttgaagaaaaatcgaatgaaataattggagcaattgacaatgtagaaagcgcagtgagtgatactactgctggttctgagttaattgctgaaactgtagaaattggcaacaatattaataaagaaatcggtgaatcactcggaagtaaattagataaattaacgagtttactagaacaaaaaattcaaacagctggaattcaacagacaggaaccagcttagctgtagtcgaaagtgctattcccgttaaagttgttgaggatgatacagctgaatttgttggtccattattaccagctcctgaagcagttaataatgatcctgacgctgattttttccctgcccctcaaccagttgaacctaagcgagagtcaccggaagaaaaacagaaaaaagaagcatttaatttaaaattatctcaagctttagataaattaacaaagactgttgattttggatttaagaaatctatttcaattagtgataaaatatcaagcatgctatttaagtatactgtcagtgctgctattgaagctgctaaaatggttgcattaataatggctgttgttattggaatagacctactgatggttcactttaaatattggtcagataaattttcgcaggcttgggatttgtttagtacaaactttaccaaattctctagcgaaaccggaacgtggggtcctttattacagagcatctttggttctattgataaaattaagaagctgtgggaagctggagactggggcggattgacaacagctattgtcgaaggacttggaaaggttctttttaatttaggagagcttattcaacttggaatggctaaattatctgcggcaattcttcgagttattcctggtatgaaggatactgctgatgaagtagaaggaagagcactagaaaatttccaaaatactacaaatgcttctcttagcaaagaagaccaagaaaaagttgcaaattatcaatataaaagaatgaatggcgatcttggtccaatagcaaaagggctagacaaaattgcgaactggaaaactcgtgcatctaactggattcgtggtgttgataataaagaagcactaacgactgatgaagagagagcagaggaagaagaaaaattaaagcaactttctccggaggaagctaaaattgctttaatgaaagctaatgaagctcgtgctgctatgaatcgttttgatgaatacgctaattcagctgatatgagtaaagactcaacggttaaatcagttgaagctgcttatgaagaccttaaaaaacggatggatgacccggatttaaataattcaccggcagttaaaaaagaacttgctgctagattttctaaaattgatgctacttatcaagagctcaagaaaaatcagcctaatgccaaacctcaaacttctgctaaatcgccagaagcaaaacaagtccaggtaatagaaaagaacaaagcacagcaagctcctgttcaacaagcatctccttcgatcaataatactaataatgttattaagaaaaatactgtcgttcataatatgacacctgtcacaagcacaactgctcctggtgtatttggtgcgactggagttaattaaggaataatatggcaattgttaaagaaataactgctgatttaattaaaaagtccggtgagaaaatttcagccggacagagtactaaatcagaagtaggaactaaaacatacacagcccagtttccaactgggcgtgctagtggtaatgacactacaggggacttccaggtaacagatctatataagaatggattattatttactgcatacaatatgtcatctagggattctggaagtcttagaacgatgagatctaactactcttcttcatcttcgagtattttacgtacagccagaaacactatcagtagtacagtatcaaaactgtcaaatggattaatgtcagataataattcaggaacaataagtaaagttcctgttgcaaatattcttttacctagatctaaatctgacgtcgatacgtcatcacatagatttaatgatgttcaagatagtcttattacaaaaggtggaggtactgctactggtgtgctaagcaatatggcttcaaccgcagtatttggagcgctggaaagtataacacaaggtataatggctgataataatgaacagatttatacgacagccagaagcatgtacggcggtgctgaaaatagaactaaagtgttcacttgggatttgactccgcgctcaacagaagatttaatggctattattaatatctatcagtattttaactatttttcttacggtgaaactggtaaatctcaatatgctgctgaaataaaaggatatctagatgagtggtaccgttctacttttattgagccgttaactccagaagatgcagttaaaaataagacgttatttgagaaaatgacatcgagtttaactaacgttcttgtagtttcaaacccgacaatttggatggtgaaaaactttggtgcaacatctaagtttgatggaaaaacggaaatattcggtccatgtcaaatccagagtatcagatttgataaaacacctaatggtaactttaacggattagctattgctccaaatctccctagtacatttactctcgagattactatgagagaaattatcacgttaaaccgtgcttctttatatgcggggactttttaatgtattctttagaggaatttaataatcaagcaataaacgcagatttccaacgtaataatatgttcagctgtgtttttgctacaactccatcaactaaaagctcttcgttgataagttcaattagcaacttttcttataataacttgggcctaaattcagattggttaggattaactcaaggcgatattaatcagggaattactacgctaattacagctggcacacaaaaactgataagaaaatcaggggttagtaaatatcttattggtgccatgagtcaacgtacagttcaaagtttattaggctcatttacagttggtacatatttaattgacttctttaacatggcatataactcatctggattgatgatatactctgtaaaaatgccagagaatagattatcctatgaaactgactggaactataattctcctaatattcgtataactgggagagaattagaccctttggttatttcattcagaatggattcagaagcttgtaactatcgtgcaatgcaagactgggttaacgctgttcaagacccagtaactggattgcgtgctttgccgcaagatgtcgaggcagatattcaggttaatcttcattctcgcaatggattaccacatactgcggtgatgttcactggatgcattccagtgtccgtaagcgctcctgagttatcatatgatggagataaccaaataactacatttgatgttacttttgcgtatagagtgatgcaggctggagcagttgatagacaagctgccattgaatggcttgaatctgctactataaatggtattcaaagcgttctcggaaatagtggaggtgttactggactatctaattcgctttcacgacttagtagattagggggaactgcaggaagcatttcaaatattaatactatgacaggaattgtcaattcgcaaagtaaaatattaggagcaatataacaatggggacctttcggtccccatatttttatttacggaatgaaatgaaagcagcaactgaagcaactaaactgtcttcaatataaacttcaatttttaccggagcttctgactcaaatttacctgttactacaccctgaaaaatactttcagtctgttctggctttgaaaaattttcagaaggaaaaattccgaactttttatctgttccaaaaattttgataaattcatcgtaaactgcttcattaaaagcattatcagcaggaataacgccttcaactacaagttcttgacttaaaaagcgcaaagaagatttcattttgtgttcctcatgttatgtcagtaagactactataacacaacacgagggacttgtaaactacattttgaactttttagtacgcggaataggcatgcgtcaattttatactgcttcattgtttgaagagcagtatcaaaaacagcattaatgacgccaattggatttccacccaagtttctaagcttaaccagtgataatttctcattaacacctatcattacgatatgcatcattttatcgcccggcttaacgtttttattcgtatcaccgccagaggtgtatgtacaaaatctaaatccaggaagcacgctttcttcgccggcttgaatagcaaaaatttgtggtattttatgcttaggatttaagttaacaaccggcgccgaagcgccgtcaaataattatgtaataagttccatgatttatccttgaacgaacttgtaaggcatgtttgcaatatctatgcaagacgcaataattccaagagatgattctactttctgtttaacatttgatgaaacaaatgatgcaaagtcaactctgtcttctatatcacctgtcattgtaaccaattcaccagtttccattaaatggtctccgtcatagattaccgattcggtgagttcttctgtggtcataacttcagcttgaataagcttgttgttagttctaactgttccatcgttgtaagatgcatcggttattttattaactttgaccattaatccacgtggcaaaatgacttccatttcatttgaaggcgctaaacttccaccgggtaaaacaacattaaccttatcagccccagtaataacccatccaattccaactaaattatcgctagaatttactagtccttcatcagttttatcaatagaaacacttagacgcttttcgtctggtaaaacacccacagatgaatcagtcatccaagtaccaaaaatatttggatataatgatgttgacacaaagtttctaaaataaaaaactcgattttttaccattgcttcatatattgaaggtaacattcgttgtgaacgatacaaagtaataccttttggtaatcgttcaccatttttaaaggctgaatctaaattatcaatggcttgttctatttcaggtgctgttaaaatacttgtacgctcatctggattatataatcccaaaagagcattatttatgtctacatatcctgaacctacgtattcacgaattccgcgtttttgtgctggtgtgtatttagatgaatctttattttcgactataggatgtaatgaccatccagcggtaagagcatatccacgtaattctcttcgaataatctttgtttttattgcattccaagaattttgtactaactcatttgcagcatcttggtttaaatgcgaatgtctgttaatatttctttcaaaccaagcacctttatatttttctaaagtatcatcgacgatagaagcaatagtttctaaagtttttattgaagtaatagattcttttcgtaatttttctaaagctttattttttatttctgcattaataatggattctttatcttcaggaattatagaagcttctctgaatgccatcccagctgtaacactgctaagagcattctctagtgcaaatcctgaagtagaaattaccgttaattcattagaatcagaaattaaaggagcgtccgctggtttatttaattctgccgctgaagcctcaaatttttgaaacatcggtgtttcaaatctagaagattccaacgactgactttgtgcaattgctctacgggaaattttaactttaacgattacagcttgatcagaacgtttatcattttcttgtgcaatagatgctgcaattgcctcatttttagttacttgagctccagtatctttattgatataaacatcaccgaccttcgattcaactttagtaaagagctcggtactaatttccggaacccctggaatgtcttctagtgatacatttttgcgatgtataagaatatatgcatactttttatcataatcccagagttccttaagaaggacgtatctgccacctgaacgactacggataagtctatcagcaataacttgaatttgtcgagcttgaccagcagttttagacttaagaatacggagcatacaggcatcaattttatactgacgcattgtttgcattgcaacagtaaaaaccgaattgatataattaattgggcttggaccgagaccttttaatttagcaattgaacctttagcagttaatgtaaaaggaacaatatgcatcattttatcgcccatctttaaatcgcgattagtatcacctccagatgtataagtacataaacgaaaacctggttgttcaattgcgtcatcaacatgaactgaaaaaatttgtggtattttcttctttggatttaagtttgtaattggaagagtagtatcttcgtcaaataattctgtaattagttccatcatatcctctctagtgtttattctatttataaaattaaaggcccgaaggcctttaataatctattggtaagagagtacgatatatttcaaactttggacctttttcataggcatcaaatgtttctgtgaatttattataagcatatgcatctataaattcaatcataatttgtgatacagaagtagaaacatctccaccttctttttgagcaatgacaattgtttctaagtaagctttcatagaccagttacctcatgaaaatcaccaaatacatcctcgaatgtattagctttagttttatcttcacgtaaacgaatcgcaatcggaagaaataatttaacgtaatcagtgcggccatcagattttaaccaaccgttgcattcgcactctagaatttttccaatataataattttggttttccataatgcgagtacggtcaagttcatgtgattttacaccggctttatcttttaagcctgaaccagcatttaccttaatttttccacactctgactcaagaataaatccacccgctttagtagggtctttacggtgaggataaattcctacaatttttaaatcaacatcaattacttctttaaatttatagagattttttgaacgagcattttcccataatccatcgatatttttgagaataataccttcaagaccttggtcaatatactttttataaattaccttagcttcatctaggttatttactacctggttttcaattaaaattactttatcatagcctgatgtcatttgttctagtttagaaaaacgtacatcatatttcaaacgaaatgcaggaagaccgtatatttctaccaacgggacataatcccagacctgaaacttcatgcatttggcttctttttcggaaatggttccttttaaggatttattggcgattccattagaagtagtacgagattccgctacttcggcgaattctttagctttactaatttcaggataagcatcaaaaagaaaatctaggccttctggttcctttttaacttgctcatggtataccaattcgccatcaattaacacgccttctggatgaatctggcgggcttcagcggtcattttgattaattcttccttaagaagatctaatcctagatattcattaccagctcgtgataaaagacgaacgtcatctaattcatcacctctgacttcggcaaagcaccgagctccatcagcttttaactgggcaaaggctggaaatttgatattcttattaatgcctttttcatcataagaacttgcgagcatttgaggttgttcaggaattaaacctggccaaactttgtttgcaatagatactgaagcaccacattcaaggtctcgcatcatcactcgacgcaaaacttcaacatcatcttttttaccgtcagtaatataaccaattaattcttcaattgccgcatttccagtcaatttccgagtagctaacgtgaattcaatgaagtcaagcatatcagtaagagtcaacattccaaaactctgggtagcaataccaggtttaggccatttcttgatataatactgtaacccacgagaataagtcagacgatatactcgtttaagcaattcattatctttattcttttcaagaattgcttgcttctgcttagttgaaccaatagatgctatttcgttcagaattttaagaatcattgttcatcctttagagtttggtttacagctctattataaatcaattcatcattaagctcagtcaaagacctgtggtacgtggttctaactttatttccttgcatccagtgcttgacgtaaatgaaaccttgctctacacattttttaaaaattcgttcgtctttttgagctcggaattctggattgcatctaaaaaattgatttacgtgaccgtaatcacgcgtagtattaccttcattttcataaatagtgtgaacgacaaacattagaatgctccttggaaaatattatcaccactagtaaatctattaaaataccctgcatcgccaggcttggtataactccacgtatggaatggattcatatgatatgggtgtgtataatatggattatatggatgtgtataatatggattatacggattaaatccaggagttctccaggtagtgttccaacgaaaagaatcgtttttaaccatcttctcaattacatcttttatagctttttcactatcaaaactttctttattttcctttggtgaaaaaagcttattttctacatcattccatgtataaactcgctgagcggtttttggaatattgtcacgctctcctcgcgccatccaataaacaggaacatttaatatttcactcgcatgatcgcaatggtgagcgagatcgtcaatgtaacaaattacgttatatttctcttttgcctttttgaacaactcttcttttgaagaatcatgaccacacatcattacttctgagaaggcaccaggaaaaagagcattcaaattaaattgacgattcaacagagcgtcaatagaatcacccaatgctgtaacagctacaaaattataatcttcttttaatttgttaattacacatagggcatctttatacggagacaaataacgaataaaatctgaacgattgtatttttcaattaacttgacgccaagttcttcatcacaattaaagagtttacctggagaaataaatttctcatcttggatcatttttaaaatatgttctaacggaagattatatttctgagcaaaataaggaaggcctgattgccagcttaaacatactccatcaatatcagttaaaatagtaggcttcatagagagtctcttaatagatttaacacatcaataaattcagcttcggttagtattgtatcatcttttgttagaccactagccatgctgtgcttcaaaacttttcctttcgaggcttgtaatgcatcacgaaagcccttgttttggatcgctgcttcaaaatatgcatttgtgtataattctttccatgcttcggaatatcttgaaaacggaactccaatccagaagagggtcccacggtcctgagctctagcataagaccttccagcttgttgggcggcaagcccggataacccaaatatacgacgctgttgttcaacatttttcaccttgcatccttggaggaatccttcgagacctccaaattggataccatccataacaaaaggccattgggcgaaattacttaatgcacatgatggccatctaaaattgcttctaatctctaactcagacattttcaatacttataatttcaacatcagcccaatgaccatagcaaggaagacgaaattcaactggccagttagggtccttttctaatataatagactcaacttgcggttcttcatgttcatcagtatacggatttttatctgttactttatatgtgaccttaatgtactgaattccaaaaatcttattaattatattcatactatttcctttaatccgtagataggagataattcatcacccatacgaaggtcttcatttccatctacccagaaaacaatataagcctcttttatttgaataccactccatttaaacggaggtagaaccttagaaattaatccaggtataccaactccctttaattcaacagtttgacctaaaaagaatttcattaaaacctcatctgaaaaccgtgcgatttaacattaccgccattaatatcagaactattaatttcacgtgcaattgagggatcaatgtcaatttcgcgattgagtttagtgatagctaaagtatcgcgcccatttacagtacgaaactctaaaggacaaaccacatcaacgtagtttttaatcgattcgctagtaggttgcaaatgtgcaggaaggtctttaggcgcctttgagaaaactacttcgcagaagtttttacgggtatcaaaataagtagtcataaacataacattttcctcagtaaggggccaaagcccctcatttattttaaatatcaaattcgttaagaactacatcaaagattgcttcaagatgctcaggtttagctctgttactcagaatatgacgaatccaagttttaactaagagtttacgattagcaccattccagcaaggatgagtccctaaatcgcgttcacgaaaatcatcatccagagcgattttaaagttggaaccttccattgtgattgaaaccgtgatgccattttcaaatcgcatataaacgtagttaggagtcatatactgttcaatttcgcatactgatccattttgatgtttccaaaggcagatggtatcaatagaacctgtaataccattagaaacatatttacgttcaaagttaatgtagttcattttattctccaagatgtttaattgcggtacaggtatataatatcatgtcctgtaccaaagtaaacaattattttactactttccaatactgcatgtcaagtttaccgacttttttcatcttctcaattaagcgttcggcacgttggcgagctgtaacataataccattcacctaattcattttgttcaatttttccaacgattactgtattcaattcataaatccaaccagtaaagaaattatgaacttgaattgtaaaggtgaaatctgttcccataccttctgttgtttctacttcaataatatcaccttcaactgccattaagaaccacatagtttcatcatatttaccattgaagcatttagttttaactgcagcgttcagattaatcgttttcattttattctcctttgtttgtgtaagataatactatcacaaaggaaccatactgtaaacaactttatgcaatctttggaaaataaaaaaggactcccgaaggagtcctcaacttatgctttctgcttaccaaaacgagaagcatcatctcgaagaaccgcacgtgctcggcgcatgatcttctcaacagtttgattgatacgagagttcgacccacgcttgtagccagcgcgtttagaatcaccaactttcttttcaactgctttctttgctttagcttgttttgccattataaattctcttttaaatgaaaatgcaggacttattggcattgcctgcgcaagccctcaaggggaacataggtttttggatatttaacgaccaggataaccataaacccgtcatcataccttatagctcttatctgttgcacaccgttagcttaaaggttccgggttcgatttctcgaggataagatatatactgatggatatataggccttgaggcgtactcccgattggccatcacctcggggtagcatgcacttgccgctataagaataacattcaagaggtacaccgtaaaactgccggggtcttaaaactataatgattcgcaaatcattaatcagacagttcgacggctcctcgattttagctcacactaaggcagtgaatctccaataaattacttcaatgttaccacaaagtgacgaactgcttttcgcgcagcagaagccaaaggcttagcatatttaagttcatctttttcctgaagctcagcagctaatgcagtttgagcaggattcagatgtttgaaataacgcaggatttcaagagcttcggcttcaacatcaatagatgcgccatagttttcgtgaccattattccatgcgtttcgttgcagttcaagagcgtgttgtaattgtttaatcatttaaaaattctcgttagagattaaaactcggtagtcacgttcttctgaatttcatcttctttcgacagatctctcagttgtagactaccacatagaattgttcggttaacttattattccgacacccaattcatattattatttatatcacttataaagacacggaatagctttatagtgacaagtaacgaatttttgtttaatttcttttggctgcttaagacccagagctacaaaaggatgcggaacatttcgaatttgaccaactggaagagaagtcaaatcaccaacttcgcagaaaccttcaggaacatcaggaccgacagagtgaactacacacagttcaggaacttcaccttgaacacgtttaccgataataagtcctgattctgtaacttcttcatcaccggcttgtgcaggttcagaaactaaaataacatattcaccgacagcacgaattggtagctgttgtacttcagacatcgtttttcctttttgttaacagatgaattaataataacaaataattcttaaagcatttatttaccaataaattggagcaaatgctcaactttcataccattaacggaaatcaatttgtcaatagaaaaacctcgccatgcaccaagctcaacatcaaataccggaatcatgtcagtagattctttccgagtagattcagtcaatttgccagtttgcatggttggcataaagtccgcgtcgcgagtacctttcataacacgaatagtaccgtcagacttttcaaaaactacgtttgaaatacccatggacaatttagttttcaaaatttcacgaattgctactttctgttcagttgtcagtttcatttatttacctattacagttttaatatgagttgttccacgttctttaagagtggaaagcaatttttggcatttttctaaatcagatttccaactatacggcctatcaatacaaacccattctgacttataatactgtttccatttagagaaaaaatatttcttatactctacagcaaatgaaatgttctcgttagaataagaactaattgctgtgagctgtaccaaacgaaatttcattattcaccacagaattcgttgatattttcccaatttaacttatttaagtttttcttaggaacattaaacacttcaatacccgcatttcgcagaatatcatcccagccaggtttatttttatcgtatgtttcgcaataaaccagttttttaattccagactgagctatcgcttttgcgcaatccggacaaggagaaagtgttacatacatagtagcaccttcaattgaagaaccatttcgtgcagcaaacaaaatcgcatttagttcagcatgaatttcatttttagatgaccattccgagtgagcactacgatgttctttcgccaagacaaagcgatcagttgaaccaaatgatacacattcaggcttatgaccttgaatgatagtatgtttaggtttattcagcaaccaaccttgctcagcagcataatcacaacagttcacaccccctgcaggtgaaccattatacccagtagaaataatacgtccattcttttcaattactgctcctaccttccaggagcaacattttgattcttgtgatactaaatatgcaatttgaagtactgtactcgctttcatttcataatcaccagataagcagatttagcagtttcaacacgataaatttcgtgacgaagtttagttatacttttaataacagaactaattatattctgcccatctttaaagcggtttttcttatcaataaaaattgcaccaaccatctttttgtgaagctcaactggatacttcgtcacaataatagcatcatacacagaaggatgaatactattcaccaaagtatcattcattaaagttattctaatgaactttgctgtttcagaatcaagcgctctatgatcgccagtatcattttcaagacaattatcaattatatcagttaaattcatcatagtacgccatacaccctttgtgcttcaactaatccatcgaaatccagtttaagatgcgatatttgatcgccatcacctggattcacaattactaatactgaacgaggagtttcggtaataacacgaaccgatgtttcaggaaatcgttcagaaaccctatttactaattcctgcgcaaatagtttaactttttcttggaattctttaacagtaattggtttttcacttagcatgttgatcccagctccttactttcaacgtttttaactaatttgacagaaactaattcagcatcttgagtaatcattaccggaccttcttcatactcttcaagatattctagagctttctttttagcttcttccttcgtatcagtttgagcatagatatagaacatacaaccagtaatacctactactttccacttaatttctttatcagttttaatttcaaatttacttacagaatcatctttttgaacttcttcgaaaaaagaatattctaacatataagcaattgaaaataacgggctaactttataggattcacccattacatcaacagctttataccaacaatcatcaatttcacgtttaatgctaataacatttttcgcaggatctatttttactttaaatgaattttccccaataaactgggcaattcgtttattagccccgcaagtttcattaaaaatatctttatatccagctttaaagcgataaaccttatcttcttcaaaccattcgctcatttcaatttcctcatttgttttggtagagctataatatcacaactctaccgtaaagtaaactattaaattgctttgaattctgatgtctgtgattcaaagcgaatgtcgcctttgataactagctcagcatcaagaccgaatacaacaatgatatgcgcggaacctggatacaacgtaatggcaatagaatccacctggtctggaagcaaagcgttcaatacatgagtcacttgagcgtggattcgaagttcagctgcattatcaagtttttcaaacatattattagcgataatttggctaaacactacttctacgattttagagtaagtcggaaacatatttacctcacataattttcttcgagccaatcaataacatccaaagcgttatcaaaagttgcgccatctactttgtcttctgtttcataatcaagaacatctaggcctactcttccgtcaacaataggccatagacaaaatagatatttcttttctttttcaattttatcacaaagacgataaatcttttctaggttattcatacgttttccatggtaaaggcagtttagttttctttactactagttcaacatcaggattcttttctcttaatttaaggcattcctcccatgctctattttcactagtaaatacacaaaattgcccattactagtaccaactaaactgctatttacaataacaatagcccaagtttcatggtgccaagccattaaaaatctcccgaagcgacttgccagcattcaacaccgatgcggcgccacatttcaactacttgagttcggtcatcaatagctaatttcacatcaaaatgtggtgcgatgtgtttccagaaaatttcttctttaactacatcatctttacgggtatcgccttgttcgcgttgacactgcatgactaatggaacaccagcaatgtcctcaacccatttacgggtcatacgataatatttcgttgggtcttcttcggttccactttcacgacctgaaacgactacgatttgataacccataagagcatacatcttggatagttcaacgaccattggattaataatatcggtatcgcatttttcaaggtcataaggaccacgaccattcatttttgctaacgtgccatcaacatcaaaaataactgcttttggtttaccaggagtccctttatataccggaagaccgagatactctcgcatgcttttatacattgagcgtaaaacatcaatcggtactgctttagttccgcgttttgagttacgtttaaccaattcagtccaaggaacatcaaacactttatattcaatttgatgcccaagctctttggcaaactcttcccagaccttacgtcgttcaggattcagattagtatctgaaacaattacacccttcgttccgtcttggcagagaatcatatgtgccgcatcgtgttgcatataagtcacgatgctttctttcttcttggtgtatttgtactcatcacgttcttcgtgtgccataacagactggcgataatcatcacgattgatattataaaacccgggattcttagcaataaattcacgagcccaagtgctcttaccagaaccaggacagccaatagtcaaaataatctttttcatcatttaattcctaagaaaacttcaagaatacgaatattatgctcacgccgtcctttgtacaattcagctgttgattgattcactgatttactttgaacattagatgaaataaattttatcatgtgatttttaagctgatacatatcaagcccacgagctttcgcttcttttcgcagggctttaccagcatcatctaaagctttagcatgttcaatgtcttcgctaatgcttgatacattttcacggcatgcatcaatgtaacggtctgagcattcaatataacgttctagcagagttttcatttatttttctcaaccaatgattgaatataatcatgtaggtctttagatgctttgccccacttattttgatattcatttttgagattagcacgtgattgagctaataaaacatcattagttggaggtaaagattctaatcgctgaatctggcgtccataaatcattgcagccatctcggattcataaatcaatcctttgagatgttcaaattgatgccatgaaatcatttacatttatcctcttttaactcttgacgataataacatatcatagttttctggtcatgtacatatcgttttacatcattaagccaaatacgaaattcctgggaatcttcgaatggcataccgacccaagctttaccatcaataactttaacttgccaggatagtttagcttcatcatatgactttatctgcacaggccaattaggatgaactgtttctttctttacttctagaggctttgtcgaacaaccaactagaagaccaatagataatattactgctgatagtttaatcatttagaaaggtcctggatgtcttctgcgaacttgttgaaggagttgttgatttgtttttcaaccaatcctggcttatgagccaccacatccgccttctttgcgtctttgcgcagtttttcattttcacgctcaatagcagcaattgcctcacgatttttattattcatcgcatcaatataattatactgaattcgcaaattatttaatgctaaggcgttttcattggccgtttttgtaatttcagtaactgatgtttctaatctttctaccttattttttaaaataatagatgttccgccaaatgctattacaagtaatagcaatccagctgttgtattacttaattgcataaagttttaataacctctataatatcgtcttgagaaagaccgttaattaaaatatgatgttcagctggagatttagaaattttaaagcatgcctcaacatcttctgccatatccgatgcactacgatttggattactaattccaagacgatgctttccagtcaaaggattaacgatgatatagcatttacaactattgatatgaacattaggttgagtctgattaatgaacacttcacaatcatacttagcgagttgattttctaaaaagactttcatctcctcaaccgcatcaggaagcatatcacgggcttgctcaagacgacgatttcgatattctttaatggtcgttttccgcttgacttgcttagctaaatctttcttaagatcggtgatatatccaactcgacgatttcctttaaatacagaaatcccatctgtagtatcaccgtatgcttcaacgaccatttcagtagtaataagctgcaaatccatcataaagtcctcatgttatgtcagtaagactactataacacaacacgagggacttgtaaacagcttagtatccttctgggataaattttttataatttttcaaaaaattctgttcgatttcgcacatgaccttttcttgactatcgtacccctgatataggctcataatgataccgaacaggtgatccattccagcacctttagcaacgccttgcgcttccatcgcataagtctttctatctttaccgcaatgcttattgtgatagtcaagaactaaaaacagagctcggtctaagtacttcagataagtcgtctcaaatgcttcaatttttctatatgaatattcatcgtcagcgtacattgctttaagatcatctgatgcaccatcaataatagtcttaaacaatttttctggattatctaatgaactttttgtactatgaagagacacgtaccaatcagacttaattttaaaatgagaaccatctttcatcacggcaacatagccttcgatgttttctgcatttttagcttcttctacccatttaggactatcgatttcgtatcgttcaactagatatggacgaagaatagcatctttataaatatcatcatatgaaatgtattcgcctgtttcattttcacgaatattcaataagatgattttcatctcttgataagcaagaacgattctattagttggagcgacgaattcgaagttagcagtaaatccatcttcagctaattctttaagtctatcacgcaaccgatggtgattaatattcatcaaaataccattagccattaaagcctgttcggatttgattgaaccctttgatttgaacagaatttcatcaccatctaaataagttgataccaaagacccatcttcctttgtcagaatgtaatcaacatcatttaaatcgatattcatcgtgaatggattttcatttaagttaaaaaacttttccataggacgagaagcaattcttactggtttttctccatccatttcaaacatgattccacgacattccaatgcgtctggaagtaaccaatcagaataagatgcataattatatgagaaaattctgtaagttcttccagatgcacttacatcatccgagtaaaaaaacttacgctgtgaatccttacatagttccattaaattgttaaaaagttcttgcattgtgtatcctcttttgtgttttgaatatagtaccacactccatgtggaagcatcattttttcttgtgttgaatattccaaggcgggttaaacagtttaatgaatagtggttcctctaggtcaatcgttgcgattgtcattgtacctaattcgtttgtcatagaaagattaaaacattggcgggcgtaaaattcaactttgcttccttcctttagcgcagcatgaattaatgcagatttagtagaatcagacgttttgtctttacgattaatagcagttctataataatttattcttttacgtaaatttttagtttttccaatataaacaagctcatcatttatagcaatagcataaattacgttatacttgtttggaatagataattgttttatacttccgttgtcgtctaattctagctcagtatatttaataaatgaatattctgttgcaatttctttcataataaaatgggccttgcggcccactccttaaaaatattttttaaaactcatcataactttatcatcaacatcattatcaatctgtgctacaaggtaagatgacagttctacttcttgcggtgcagattgaacattatcagaattaagatattcacgaatccaaggatatggatgtttaaccggagcatcggtaattgggcatggaagaccacactgcttcatacgagatacagttaagtaatcaataaagctccacatgctatttgtatttaatccaggaacatctccatctttaaataaatgaactgcccaatctttttcttggcggttaacttccatgaaaatatcaactgcttcttgttcacactctttggcaattttaacccattcatcaccatccgtgccaagttgaagttgacgaataatatattgagtgcctttaaggtgaagctgctcatcacgtgcaatgaacttcataatcttggcattaccttccatgatttccatgttcttatggaagttaaaggtaccgttatgttcgattgagctcgctaattctcaacccgttctcttatgaactgctacatattactatgcagaccagactatatcacaatcccagagggattctccccatttcgagtcgcttgaccctacgtccgaagactagtcgttgaaccttgctttgcaattgtcgccgtgccatcgtttatatgttgatggtgataaatctttcttatcacaatatggacaattcaattgaattctatttggatttaatttacatctgtcattatgttttagataaaatccaggacctttaccaatgtgaccgcagaaatcacatgtgatttctttttgtgcaggatgggtcccgttcttaaccatttctaatgtttttgctgatgttcttttcttatggtcttctgacaagaaatgatgtgaaccgtcatttacccgttttgattgagtttctgactgcattttaccaccgcaaaatacatgagtaccttcttttatagctgcaatattgcgttctttaacttttgcaatatgctcagcttgttgaaaattatgtatacctaatgcaactctatttaaattagatttacgctgtatttcaccgtctaaaagatgaaatgtaccattttctatcttagatttaatagaggcaatatttttagctcgtacttcagggatattaaaaatctggatttctctagattttgcggctttagaagctaattcagaaatttcttcaggagaatatttcattctaagctttatagcatgacaagcctggtaatctttttgagctaaatgtatatcataatgttcctgtatagaaaggcacatcaaattatctaaatcattattttcacggttaccgtctttatgatggatttcgtatgttcttccatcagaatctttaggtataggtccgttagcatctatccaaatttttctatagttcaattgtgcatcctcttaaaagtataatcatatttatattatactaattaaaggtgcaagcaaaaccttggctgctagttttcctataaaggactttccagcaattaaaggagttttcgataaacgttaccgtttaaaggcgcattttacgcaaaagatacataaaaacgaatagcttctaaggcattaataacgtgtaaacagaggtaaagagacttcattaaagcacgtttagcttcggcttcttgtttaatagctcggtttaaacgaaagtcggcatcaggagattctttagctagttctacaaattctttagcattttcccattcacgggttttaaccaagacatcatcataatagcgtccaatagattcggctcgtttcatgattgcttcatctaatacaatctcatcaaatacctttgacggatcagtataaagatttcgcatgatatgtgtatatgaacgactgtgaatagtttcactaaaagtccatgtagcaacccatgtatcaaggcttgggtctgaaattaatgacataagtacagcagacggcgcacgaccctgaatgctatccaaaagtgattgatacttcaagttgttagtaaaaatattttgctgatactgaggaagcttattaaactgtgcagcatccatcattaagtttacttcttccgggcgccagaaaaatgataaggacttttctgtaagttcttcaaatactcgatgccgttgaatatcataacgcgcaataccaagacctgaaccaaaaaacataggttcttttaaaacatcaactggatttgtattaaaaactgtgctcataaattttccgcttagttaatagttggtgactcgtccgtgagtcaaattatatcataatttacaggatgaacaatcttcagcttttggagtttctatttcataatcatcagtaccagaaccatcacgggtattatgataatagaaatttttaatgccataataccatccgtatagcatgtcatcaatcattattgacattggaacctttccttttggaaaaatctgcgggtcatagtatgtatttgctgaagctgattgacatacccatttaagcataatagctacttgcgtaagataaggtttattacctttcttagctaatttccacgtataatcatagaggtctatgttatgctcaatattgggcacgacttgattaaaggaaccctcttttgattctttaacagagactggtccacgtggaggctcgataccgtttgtactgttagaaacttgggaagatgactcacatggcataagtgctgataatgtgctattacggatgccaaagagcttaaggtcttcccgcagcgacgaccagtcacaaacgtattttggagctgcgatttggtcaatctttttattgtaccagtcgataggtaattcgcctcgagaccaacgagtgtctgaataatattcgcaaggtcctttttctttggcgagcttaatggatgctttaatgagcccatactgtaatctctcaaatagttcatgtgttaaatcgttagcatcttcataagaagcaaagttacttgccagccaagctgcatagttggtaacacctacaccgaggttacggcgctttttagctttttctgcttcaggaactggatatccttggtaatccaaaagattatcaagagcacgaacttgaacttctgccaattcattaattttatcttggtcttgccagtcaaaattatctagtacgaatgcagagagagtacacaatccaatttcagcatcaggactattcacatcatttgttggaatagcaatttcacaacacaagttactctgacgaataggcgccttttcacgaataaacggagtatagttattcgtattatcaatgaactgcacataaatccttgctgttcctgaacgttcagtcatgagcaattcaaatagttcacgggctttaatacgctttttacgaatattagggtctttttctgctgcttcgtataattcacggaaacggtcttggtctttaaaataagaataataaagctctccacccatttcatggggactgaacaaagtaatgtaatcgttctttccaaaacgttccatcatcaaatcattcagttgaacaccataatccatatgacgaatgcggttttcttctacgcctttgttatttttcaaaacgagaagattttcaacttccaaatgccaaataggataataagcagtagcagcgccgccacgaattccaccctgtgaacatgatttaactgcagtctgaaaatgtttccaaaaaggaataacaccagtatggcgtacttcacccatgccaatcttagaaccttcagcacgaatcataccaacgttaataccaattccagcgcgtttagagatatattcaacaatcgaagcggaagccttattgatagacttcaatgaatctcctgcctcaataacaacgcatgaactgaactgtcgagtcggagtacggcaaccagccataataggagttggcagtgaaatctgtcgagtagatactgcttcataaaaacgaataacatgttttaatctatcaacaggttcatcttgatgcaatgccattccaatagtcataaatgcaaactgtggagtttcataaatttgaccagtggttttatctttaactaaatatttttcttttaattgcatcgccccggaataagtaaattccatatcccgttcgtgcttaatttttgattctaaaaatgtaatttcttctgctgaatattttgacaacaattcagggtcatatttaccttcatttacacagtaagaaatatggtcaataaatgaacgtggttcatactgcccataaacatgcttacgaagagcgaacattaaacagcgtgcagctacatattgataatcaggctcttcaaccgaaatagaattcgcagcggccttaatgacaatagtctgaatatcatcagttgtcattccatcacggagataagatttaatattttcatataattcataaggatctactgatgttccttcagctgcccaagataaaactttaataattttttgcgggtcaaagctctgagaaacaccactacttttgataacattaattaattgcataagtcctcaacttgaaaatcgtctttaaacagtcggttaactatatgagctattatatcaccatgacacggctttggtttacatgtgcatcctagcctcattccacgtaaaggctctaaatgcgctttagttatttctccggatttaattcgacgtataaaatcttttttgaataattcaatggcagcctcccggctgccagcatctttaccgacgtaatttccccaaaatgtaccacggtgaatattaacatcaaagtcggatttatatttattcactacctggcatagacggcccgcgcggtgataattcgtcatattgtttttccgttaaaacagtaatatcatagtaacaatctgaagaagttttaactgtagaaattttattatcaaaatactcacgagtcattttatgagtataatattttttgccataaatgataataggctgatttggtcctggaacttctaactcacttgggttaggaagtgtaaaaagaactacaccagaagtatctttaaatcgtaaaatcataaatcctcacaattaaattaaaattacaccgccatttttcctttcaagacgccgtgggactgataatctttgagaacgaaatctttaggcctgagtttaagaatgtattccaattgttctttagtagaaagatagcggaatttataaggcaatccgcctattaccagttcacaaagctctttaggttcacgacgcaaaatttctttacattgttctacgtgattcatatagatatgagtattaccaccggaaaatatcaaatctcccggaataagattacacatcttagctacaatatgaactaacgtagcatatgatgcaatattaaatggaagcattatgttcagataaggtcgttaatcttaccccggaattatatccagctgcatgtcaccatgcagatcagactatatctccaacttgttaaagcaagttgtctatcgtttcgagtcacttgaccctactccccaaagggatagtcgttaggcatttatgtagaaccaattccatttatcagattttacacgataagtaactaatccagacgaaattttaaaatgtctagctgcatctgctgcacaatcaaaaataaccccatcacatgaaatctttttaatattactaggctttttacctttcatcttttctgatattttagatttagttatgtctgaatgcttatgattaaagaatgaattattttcacctgaacgatttctgcatttactacaagtataagcagaagtttgtatgcgaacaccgcacttacaaaacttatgggtttctggattccaacgcccgtttttacttccgggtttactgtaaagagctttccgaccatcaggtccaagtttaagcatcttagctttaacagtttcagaacgtttcttaataatttcttcttttaatggatgcgtagaacatgtatcaccaaacgttgcatcagcaatattgtatccattaattttagaattaagctctttaatccaaaaattttctcgttcaataatcaaatctttctcatatggaatttcttccaaaatagaacattcaaacacattaccatgtttgttaaaagacctctgaagctttatagaagaatggcatcctttttctaaatctttaaaatgcctcttccatctcttttcaaaatctttagcacttcctacatatactttattgtttaaagtatttttaatctgataaattccgcttttcataaatacctctttaaatatagaagtatttattaaagggcagtcctacaatttagcacgggattgtctactagagaggttccccgtttagatagattacaagtataagtcaccttatactcaggcctcaattaacccaagaaaacatctactgatcgttgataccactgcaaatccaaatagccattacgcacattaaactgatagaacatatgacaaggcggtaatgccatctgcttgagttcagctggattccatgcagaaacaatttgacgcctatcatttggcagttttttaatacgatcaataacttctataatttggtctacaccgccaaaatcacgccactgttttccataaattggaccaagttcaccgctatggtatcctaaatcttttgcttgattttcgtaattttcatcccagactgttttgccttggattaacgaatcatgttgaattaatcgcaaatcattgacatttgtgcttcccgataaaaaccaaagcagctcagcaatgcaagctttccaggcgagcttcttagttgttactgcaggaaaacctttagttaaatcccagcgtaatttagtaccgaacaaagcaattgttcctgtgcctgttcggtcatcggtttcatagccattttcaaaaatgtctttaattaaatcttggtattgtttcatttagtaccttatataaattataatacattttatgaagctaaataatcaatacggtttagcatcaaattttctctcaatttcaggtgtgaaatataattctttaccacgtttggaaaagcgaccaataatatgataattattctcatcaaacatgatattaccaatatccatagctttcaaccaaatatcgatatttctatccagctttatgtcaaaattccaatacggagaactattaccgaaaatactgcaagcggattcagtgaaacaactgctataaatcttgtctttaggaactactaattgatagacacctttaataaactgaggaccttgccattttggctgtttcgcgtcttcttctaatagaatagggtaataattaaaattcatattttccgccacgcgttatttcatttatatactgattccgtaagggttgttacttcatctattttataccaatgtgtttcaaccatttcacgcttgcttatatcatcaagaaaacttgcatctaattgaaccgttgaattaacacgatgccttttaacgatgcgagaaacaactacttcatccgcataaggtaacgcagcatataacagagaaggtccgccaattacactaacattagaattctggtcaagcatagtctcgaatggcgcgttatgacttgaaacttgaatttcaccaccagaaatgtaagttatatactgttcccaagtaatatagaaatgtgctaaatcgccgtctttagttacaggataatcacgcgcaaggtcacacaccacaatatggctacgtccaggaagtaatgtagataatgactggaacgttttagcacccataatcataattgtaccttcggtacgagttttaaaattctggaggtcctttttaactcgtccccatggtaaaccatcacctaaaccgaatgctaattcattaaagccttcgacggttttagttggagaataagcgaataccaatttaatcattacgcaaagcccctttcaataaaccattcagtggctttattagcgtcaaagaataattcttcatatgtcttttctttgttttcaaagactgtcacacaaacacgttgacattctccacagtattcttctgacatactcaaagcgtcagaaaacatttcattaaattcatttaaatcaggattatgcaatgcgttaaaaattgcataatcgaattcatcattcataaattcaaatacaaaaatcatattattttccttaaacagactttttcacaattttccaatcagctttaaactgctcgacgtcagaatggtaaatccagaatcctgcgctttcaccgtcttcataaagcggacacccatcacattcatcttcccatcccatgccacgtaaaaggtgttcagctttttcaacaagttcagaatctttaccgatgatattaaaataccatttacctctaacttctgaatctttgatgctctggcgttgtaatctcattttattctccttagcaagctttaatcaaaagatataaacagaccaacataactgctgccataatataaggtgcgaacattttcttttctccattagttttgatagggtaatagtatcacactactacccttctgtaaactactttttgaaagtttttcgcaaaagttcaatgatttcatctacattgttttcgtcaacaatgcagtgaatttttgttacgccagaaactttgtctttgacttcatcttcttcagaagtcggttctttatactcacgaaaacaatgaaattcgtcttcacaaacgttaaagtaaaaatgctttccatttgcgcattcaatgtgttttattactctaaatccatcaacaaagaaagcttctttaacttcaaaccatccgccattttcttgaataattttaactattgctgaattagaacgtgggcgataattaataaatgtatcaataagtcttggaacaagttcatactttttaccgatatacattatgttttcctcattttaacggggctgtaatagccccttgataattattgttcaatcaatcccatgtaaaattctgcgtcttcagaatccataccatcacaatattcattagccataaagcgggtgaggtcttcaagaggaccttcaataacgatttgaatactccaaaacttagaatcttgcacgcttgtgatactaagttcaggataacgattacgaataatttcttcgatatattcaaaatcaacgatgtcaatatcaactttagccatattattttcctctttaatcatcagcagtattgccgatagttgtatagtaccatggaaggacaaggatgtaaaccgttttgtgaaaaaatttttgaaataaaaaggggacctctagggtccccaattaattagtaatataatctattaaaggtcattcaaaaggtcatctaggtccgtgtcatcagcactagatgaactgccagagcttgagctcataaaatcatcttcagtttttgtattgaagtcatcaacattgaatgcatccaaatcatcagcaactttatcagctttcttagcagcagttgcagcagcaccgcccatcacagcagttcccataacttgaccgaatttagtgctcagttcttcaaacgatttgaatttatctttagaagtcatttcagaaaggtcaaccatttgttcgaacagttctttctggaaagattcatcgtcaatgtttggaatcgcagattgattcaggaatttagattcgtcgtagttactaaatccagaaacctgtttaactttcagtacaaagttagcaccttcccacggacaagttacatcaaccggagtttcacccatttcaacatcaaccgcaatcatcgcgttgattttatcccagattttcttaccgaaacgatatttaaatactttaccttcattttctggagcagctgggtcttttacaacaagaatattagcccagtaagaagttttacgtttaacaagactgtactctttattgtcagtgttgtacagatcatttttactgatgtactgacatactggacaagaatcgtaatcaccatgggtagatgaacatgtttcaatataccatttaccatttttcttgaaaccgtgatttacaagaattgcgaatggtgcttgttcatcatttttagacggaagaaaacgaattactgcttgaccgttacccgcattatcgagtttcagtttccactcgcctttatcttcagaagaaaaacctttattgccattcagtttagccatttgtgcagcaagttcagcagtagatttacgtttaaacattttatttcctttttaatttaatttaatttaatttaattaacagttggtgctatgacactttacctcatagctggcataattcgcaatactctgggtcttcgagaggtatccaacctgagttgaaatactttaccatcgatttagcagttgtatcagttatatttatattacctttaactcttcgccatccaggagttttaccgtacagattagaggataataataacacataattctcgtaagcaatatgagataatttccaagactctatattagctcgtgatgttttccaaggtctaaaatcgtcacggttcatataattagccaatctcatatgctctctaacttccgggtctttggctggatgagtttcaccactcacaccaaatccaccaccagcatataccagattaaaatagtctggattatctctggcatttacttcaagttggtattttcgttctgcttcaataacatccaagtcatcatcaatttgaattattttaacgctcggtttttgaagcattagcgcattcaaaaatcttttttgtttacatgagctccagtattcctttccggaagagtcatatattattccattctcaaatgagcaatttaatttactaccgatatagtagtatggcggagtcttatttttgacacggtcttcaaatgtaaaccaatatactatattcatatcaatacttacaagatttcacagtttcaataaaaacttttttagcttcctgtgaatcaatatttaaaatttttctataagcctttaactttatagaataattattccagactaaattatcagtctgttcatcatgtttatcaattatatttaaaaacgaatcaagcaagataaacgtctcaaacgaaattatgttcgattgcagaagtttaaaaatataacttgactgaacctttggattatattcaaagatttctttaaaagcagaaacttcaacttttttactgaaatagtaaatgttgcgaatatcttcttcaaacttaaatttaatttgcttcaagcgtccgatatattcacgataaaacacaagtgcatcagcgtcagagatgtcaccaatccaagcatcttggttagctacaagattgctaataaaaattaaagttaattcttttaatttatacttttctgatagcttttggaaaaaatacttatcccttcgcttttgataagcggcatcagacacccgcatgcaccaattatacttaattacatcatactttccattcatatgttgttttatcattaagtataatttataaactgatttaccatcaatgtatctttcaccaccagcaggcatgcggagtttaatcatagtagaaaatctaatgtattagttttttcacaacgaacaacagaaggacgcaaaagattttcgtcgatagcttctgactgaattttttcaattatacccgaaggaataaatttagcaaattgagtttcaggaatagagttttcttctaagaatgctgttgtagcttcaagataactcattccaaactcttctaccattttttcaataataaatccattttcttgacgatcaagaagctttgctatttcatccttttctttcttgattgaaagttctttttctgaaagaccggtctcatcgaccggacgaatgtcatttagagaaaactgtgtcataaagttcaactacctcttcagtttcagcttcaaacacatcacggttatctttatgatacaaagctaatagacgattaaacatcttaccatcaacgccaagttcatctttggcacgaattcgaatatctttaatcagttcattataaccggaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccacgcggtggtaatttatatgaattatagtaattcacaatgtttgaagcaatattatcaggaatataatcaaaatcaattagaactaaattttctttataacgattatattcagattctgtgagaagcaccttagcttgctcacggtcattagcaatagcttcaacgattgaagttttcattgaaggagttcgttcaccttcaactctggtaaaccaaaagtcagatcgtactttaactgaagcaacgttatcctttttgtcgcccttaaggattttagtcatacagtcaatttcagcagaaccgcttttaattttaacccatttcttatgcatcggtgaccattgcttaacatttggatatttgtgaagctgtgtaaagtcaccatccgatgaaatgattaaaatcttatgtccttctaaagagaactttttaacaagaacagcaatgtggtcatctgcttcatacttatcaatatccataacaatgtatggcatataagctttcaattcatctataactttatggctggattcaaaataaccttcccagtcccaagtagattcttctcgtgcttttccacggtttttcttgtaataatacgcgaaatcacgacgccaatatccagatttcgcgttatcaatacacagtacaattttagtgtatccaagtgtttttgcttttttgacattaaacttaattgagttcaatatcaaatgacgaaccattgataaattaattttttctttatctgggaagtttaccagagcagttgaaagagcaatttgactaaagtcaataaagcaaattccttctttgtaatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggcgataaaataatcaacgtagctttagctgatcgtaccgtaggaactgacggtgttaacgttgattacttaattcaagaaaacacagttcagcaatatgatccaactcgtggatatttaaaagattttgtaatcatttataataatcgtttttgggcagcaacggataatattccaaaacctgctggaaattttaatagaattcgttggaaagcattacgtactgatgccgtatatacaaccgtatcatctggaccatatcaattaaaatccggagaagcaatttcagtagatacatcagttggcaatgacattgagtttactttaccagcttctccgcttgatggagaaaccgtaataattcaagatatcggtggaaaacctggcataaatcaggttaaaataaattcttcaaatcagagtattgtcaattttagaggtgaacaggtacgttcagttttaatgactcatccaaagtcacagatggtattcatttttaataatcgtttgtggcaaatgtatattgctgattatagcagagaagctgcgattgttactccatcgactgcatatcaagcacaatctaatgattttatcgtacgtagatttacttctgccgcgccgattaatgttaagctcccaagatttgccaatcatggagatatcattaatttcgttgatttagataaattaaatccactttatcatacaattgttacgacatatgatgaaacgacgtcagtgcaagaagttggaactcattccattgaaggccgtacatcgattgacggtttcttgatgtttgatgataatgagaaattgtggagattgtttgacggggatagtaaagaacgtttacgcattataacgactaattcaaacattcgtccaaatgaagaagtcatggtatttggtgcgaataacggaaaagctcagacaattgaacttcagcttccaactaatatttctgttggtgatactgttaaaatttccatgaattacatgagaaaaggacaaacagttaaaatcaaagctgctgatgaagataaaattgcgtcttcagttcaattactgcaattcccaaaacgctcagaatatccgcctgaagctgaatgggttacagttcaagaattagtttttaatggtgaaactaattatgttccagttttggagcttgtttatatagaagattctgatggaaaatactgggttgtacagcaaaacgttccaaccgtagaaagagtagattctttaaatgattctactagagcaagattaggcgtaattgctttagctacacaagctcaagctaatgtcgatttagaaaattctccacaaaaagaattagcaattactccagaaacgttagctaatcgtactgctactgaaactcgcagaggtattgcaagaatagcaactactgctcaagtgaatcagaacaccacattctcttttgctgatgaccttatcattactcctaaaaagctgaatgaaagaactgctacagaaactcgcagaggtgttgctgaaattgctacgcagcaagaaactaatacaggaaccgatgatactacaatcatcactcctaaaaagcttcaagctcgacaaggttctgaatcattatctggtattgtaacttttgtatctaccgcaggagctactccagcttctagtcgtgaattaaatggtacgaatgtttataataaaaacactaataatttagttgtttcacctaaagctttggatcagtataaagctactccaacgcaacaaggcgcagtaattttagcagttgaaagtgaagtaattgctggacaaagccaagaaggatgggcaaatgcggttgtaacgccagaaacgttacataaaaagacatcaactgatgcaagaattggtttaattgaaattgctacacaaagtgaagttaatacaggaactgattatactcgtgcagtcactcctaaaactttaaatgaccgtagagcaactgaaagtttaagtggtatagctgaaattgctacacaggttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattagataatgttttgataactcctaaaaagcttttaggtactaaatctactgaagcacaggaaggtgtcattaaagttgcaactcagtctgaaaccgtggctggaacgtcagcaaatactgctgtatctccaaaaaatttaaaatggattgtgcagagtgaacctacttgggcagctactactgcaataagaggttttgttaaaacttcatctggttcaattacattcgttggtaatgatacggtaggttcaacacagccattagaatcatatgagaaaaatggttatgcagtatcaccatatgaattaaatcgcgtattagcaaattatttgccattaaaagcaaaagctgtagatagtaatttattagatggtctagattcgctccagttcattcgtagggacattgcacaaacagttaatggttcactaaccttaacccaacaaacgaatctgagtgcccctcttgtatcatctagtactgctacattcggtggatcagtttcagcaaatagtacattaactatttctaatactggaacggcaactcgtctgatttttgagaaaggacctcaaactggaacaaacccagctcaaacgatgacagtcagagtgtggggaaatcagtttagtggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattagcggaaattatggtttcattgttcgcaatgacgggtcagtaacgaattttatgcttactgcatcgggtgatcagactggcggatttaatggattgcgtcctttagctattaataatgcatctggccaagtaacgattggtgaaagcttaatcattgcaaaaggtgctactataagttcgggtggtttgactgttaactcgagaattcgttctcagggtactaaaacctctgatttatatacccgtgcgccaacatctgatacagtaggattctggtcaatcgatattaatgattcagccacttataaccagttcccgggttattttaaaatggttgaaaaaactaatgaagtgactggacttccatacttagaacgtggtgaagaagttaaatctcctggtacattgactcagtttggtaacacacttgattcactttaccaagattggattacttatccaacgaccccagaagcacgtaccactcgctggacacgtacatggcagaaaaccaaaaactcttggtcaagttttgttcaggtatttgacggaggtaaccctcctcaaccttcagatataggagcgatcccatctgataatggaataataggtaatcttactattcgcgatttcttgcgaattggtaatgttcgcattattcctgacccagtgaataaaactgttaaatttgagtggattgaataagaggtattatggaaaaatttatggcagagtttggacaaggatatgtccaaacgccatttttatcggaaagcaattcagtaagatataaaataagcatagcgggttcttgcccgctttctactgcggggccatatgttaaatttcaggataatcccgttggaaatcaaacatttagtgcaggtcttcatttaagagtttttgacccttctacgggagcattagttgatagcaagtcatatgctttttctgcttcaaacaatacaacatctgccgcttttgtcagtttcatgaattctttgtcaaacaatagacttgttgctatattaactagcggaaaggttaattttcctcctgaagtggtatcttggttaaggggagcaggaacttcagtttttccatcagattcagtattgtcaagatttgacgtgtcatatgctgctttttatacttcttctaaaagagttattgcattagagcatgttaaactaagtaatagaaaaagcacagatgattatcaaactattttagatgttgtatttgatagtttagaagacgtcggagctacaggatttcctaaaagaacatacgaaagcgttgagcaatttatgtctgcggttggaggaactaataatgaaattgcgcgattgccaacttcagctgctataagtaaactttctgactacaatttaattcctggtgatgttctttatcttaaagcacaactatatgctgatgctgatttacttgatcttggaactacaaatatatctattcgtttttatgatgcatcaaatggatatatttcctcgacccaagctgagtttactgggcaagctgggtcttgggaattaaaagaagattatgtagttgttcctgaaaatgcagtaggatttacgatatatgcacaaagaactgcccaagcaggtcaaggcggcatgagaaatttaagcttttctgaagtatcaagaaatggcggcatttcaaaacctgccgaatttggcgtcaacggtattcgcgttaattatgtctgcgaatcggcttcacctccagatataatggtacttcctacacaagcctcttctaaaactggcaaagtgtttgggcaagaatttagagaagtttaaactgagggagccttcgggttccctttttctttataaataatattaaaataaaggggcatataatggctgatttaaaagtaggttcaactgtaggtggatctgtcatttggcatcaaggaaattttccattgaattcagccggtgacgatgtactctacaaatcatttaaaatatattcagaatataataaaccacaggcagctgataacgatttcgtttctaaagctaatggtggtacttacaccggtccaattactattaattacggggtaaatagttatcttcaattaagtaataatgaaacccccattcgaattcgttctggtggcggtaccggtaatactcttgtagttggtggctcttctggcggtattagttttagacctgcaggtagtgaaatcactactggacaaattactattacgccagaaggtttgacaacatttaccaaagctgtaacggcgccatctgtaactgttacatctactccttctgcagcatctgatgctactcgcaaagattatgttgatggagcaataaatactgttacagcaaatgcaaactctagggtattacgctctggagacactatgacaggaaatttaactgcgccaaaccttttttcacagaatcctgcatctcaaccttcacacgttccacgatttgaccaaatcgtaattaaggattctgttcaagatttcggctattattaagaggacttatggctactttaaaacaaatacaatttaaaagaagcaaaactgcaggtcaacgtcctgctgcttcagtattagccgaaggtgaattggctataaacttaaaagataaaacaattttcacaaaagatgactcaggtagtgttatagaattaggtttaaaatatggaggaacaattgatggttctttaactgttaatggaaacataattggaaatttaacaggtaacgctgcaactgcaacgaaattaaaaacagcacgaaaaattaatggtatatcctttgatgggtcaaaagatatcacgctaactccatctgacataaatgtcaatagcacaacgtttataaaaaataacggcgaattacctgttgatgctaatttagatgagtatgggcctgttgaagaatatcttggagtttggtcgaaagcaacttcaaccaacgctcaaccagcaaataaatttccagaagaaaatgctgtaggtgttctagaagtatttgtggccggtcaatttgctggtactcagagatatacaactagatacggaaatgtttatattcgttccttgactgctacatggaacggagtaaacggtccgtggagtgcgtggcgaaatattcaatctggtactcgtccactgtcaacaacgattgatcttaatgatctaggaggcgctgaacaccttggtttgtggcgaaatagttcaaattccattgctacctttgacagaaatttcccagaagaaggatcgtcagctcaaggacttttagaagtatatgaaggtggaaactattctcgcacacagagatatacgaccagatttggtgttgtttatactcgctgtcttgctgctgcatgggatgcatctgcgcctaaatggggaccgtggcaacaagtcggtaatgtcacaccggcgactttctatgacggagacctgaatgattttaaagctcctgggttatataacattttaggcactgatgccgttattaactgtcctacaggtgaaggtttaccaaccgttattgttggtttgctggaagttaaacagcgtgcttctggtggtgctattttccaaaaatttactactgccggaacaggtgcaactacccgcgatcgtatttttgagcgtgcatataccggcggtgtttggggtacatggaacgaagtatatacatcttactctcttccaattactttgggtatgggtggtattaaatctaacttagcagagttagactggcaaacatttgattttgttcctggtagtatgtttagcgttcctttgaacaaaataaagaacatgccagctaatatggattggggtacgattgacggaaacttaattatgttttctgttggtcctagcgagcacactagcacaggacgtactgttcaggtttggcgtggtactgtatcccagacaaactaccgttattttgtcgttcgtgtgttcggtaattctggaaatagaacttgcacagtccgccgtgttgttcttgaagatggtcgccacacatggacagctcaacaagattttaatggtgctgttaacttcggtgctcctaccaattttaactctactgttaaccttaataacactaccacatttaaaacagaagttaaattccgctcgtcgactgcattccgtatgtatggcggaaaatttggtacatttttacgtaatgatggagagagtctttatattctttccaccgacgaagatgatcaagatggaaactttaatacaaatagacctttccgttatgaattaagaactggtgatgttactttaggtggtactagtggtgctaacgttttaaaattaaaacgtgattctctcaccgcattttttggtggtgatattaacatgaaaggcttgatgacttttgacgccggacgtttaggatcacgagattattttaaatttaaccattggggtgatagcaataacgctcgtgataacattattcagttagaagacagcaaaggcgctcatttttccactgaacgtactttagcgactggtgcaattaagactaaattttttggtgaaattgaatccgatggtaaattggttattaaacgtccgggtgattctattgtattatcagcacctgctagtaattctttgcatattcgtggtgacgtagacgggactggtaactggtatattggtaagggtggtgatgataatggattagcgttctatagttatgctactaatgctggtgtatacattacaaacgcaggggatatcacgctaagtccaaaaggcgtcgaaatggctcaggtcaataacgttcgattatatgttcatggtgaacgttggaccgctagtcaaccaggtgattggggcagtcagtggcaagtggaagcgccaatattcgtcgatcatggttatgtttcacaggattgttattatccaattattaaaggaagaagtgtagtcaccaatcaagggtttgtaactgccgtcgatcttggtattcgtcgtgtcaataacaattggggacaagcaattattcgtgttggatctgcggaggcatcgccagcggctggacaccctaacgcggtatttgaatttcattacgacggtactttctattctcctggtaatggtaactttaacgatgtgtatattcgttccgatggtcgtcttaagattaataaaaaagagctagaaaacggagcacttgaaaaagtatgccgactgaaagtttatatttacgataaggttaagtctattaaagatcgtagtgttattaaacgtgaagttggtattattgctcaggaccttgaaaaggaattaccggaagctgtatctaaagttgaagttgatggatctgatgttctgacaatttctaactccgctgtaaatgctcttttaattaaggctatccaagaaatgagcgaagaaattaaagaattgaaaactcctttctttactaaaattactcgcaaaattagtaaatattttaaattctaacaacaaggggcaacgccccctttggagataaattatggcagtagttggtgttcctggttggattggtagttcatccgtaaatgaaacaggacaacgatggatgagtcaagcggctggtcaattaagattgggtgttccttgctggatgagccaattcgccggacgctcaaaagagattattcataccgtaacagcaaaccacaattttaatggtcagtggttccgtgatagatgctttgaagctggcggtgcacctattgtattcaatattgttggtgatatcgtttcttattctaaagatgtgccacttttctttatgtatggtgatacgcctaatgaatatgttgttcttaatattcatggtggtgttcatatgtggggtcgtggtggtaatggtggatacactcactcaggaggcgacggtaacggtacacaaggcggtcatgttattcaaaatgatatcggtggacggcttcgtatttggaactacggtgttatagctgctggcggtggcggcggtggtggtattgcatatcgtccacactcaggggcaaactggcaagatatcggtggcggtggtggtcgacctttcggtggcgctggcggtggcggttattccggtggtgctgcttcgtatgaaggtccgggtggtggttatgactatggtaacgcacactccggcgcaggtggtaatgctggtgctgctggtcagaatgcatggtatgacggtggtaaagttcttaaagttggtgttggtggtgcgtctggtcatgcagtgtttgggtcttctccaacttggggtgctgttggagcaatatatggtccaagagtataatttgaataaatatccttaaaaggagggtctatggcagcacctagaatatcattttcgccctctgatattctgttgggtgttctagatcgcttgttcaaagataacgctaccgggaaggttcttgcttcccgggtagctgtcgtaattcttttgtttataatggcgattgtttggtataggggagatagtttctttgagtactataagcaatcaaagtatgaaacataccgtgaaattattgaaaaggaaagaaatgcacgctttgaatctgtcgccctggaacaactccagatagttcatatatcatctgaggcagactttagtgcggtgtattctttccgccctaaaaacttaaactattttgttgatattatagcatatgaaggaagattaccttcaacaataactgaaaaatcacttggaggatatcctgttgataaaactatggatgaatatacagttcatttaaatggacgtcattattattccaactcaaaatttgcttttttaccaactaaaaagcctactcccgaaataaactacatgtacagttgtccatattttaatttggataatatctatgctggaacgataaccatgtactggtatagaaatgatcatataagtaatgaccgccttgaatcaatatgtgctcaggcggccagaatattaggaagggctaaataattatttgttcgtatacatctctaaatatcgatatacactctcaaaaccctcgttgaattcgtcgatgagggttttcttatcttcttgagttaattcagaaacaattttacggaatgaattctgatttaactttctaccttcatgcgttactccaatctcattcagaaatgcaataaaattagcacgattttcaacaatatcttctctggaaaatttaatcaaaatagacgcaacagtaataatttcacgaactgtatcaatatttttattcattaactataccactcaattagttgactttgttataatatcatcagacacttgatttgtaaactggtctgtgttattttcttgaaaaattttttctacgaattccttgaacgactcgcgttcctgagctacattatgctcgattaccatttcaagattatgactcattcgaaataatcttcaatttcgtaatcatggacataaatcattatagtttctaatacatcatcaatactttttcctggaactggaattacgtaaaaatatcctgcttttgagaggtctttataagttccaatcaagaaatcattattctcaagatgcagttcttcaactaattcattaacaattgagtggtataaatttggtagaaacttatatagcttttctagaatatcaattttgattgtgtattgaaccacggactgagaatcaataatcatagaccttccccttatgtttctgtttgcgattagattctttaaacgctttcttcttatccttatggacagaagctttattaaaattgtgttttgcgactaaattgttcatagtgctgaattacctctctcaaacacttgcatgtgaatgaaaactttttagctacaccacattcaaatatatgttctcttaaatcacgtgtgtcagtatatcccatctcaacaataaaatgtcttattagatttttatctttatcattgagagaattaaaataatcggattttgaattaatttccctggccaaattgaatcaccttcagttgacgttttagttcttttatcatttcttcgttcatcgcaatataaagatcgcgtaaagcaggttttaacattccatttactggagaactaaatggacatacataatcttttcctacgagctttttggtaaattccatatcacagaactgaaatgccggttcattggcataaattccccaattagttgacatcattttattggcatattccaatgcctggatttgattagtaattccatcaatttgaaactttttaatattcattagtaaaggtcctcagagtaaagttctttttcactaccaccacgttcaatacgcacttgtccagcgtaagttgcaataatcattgcttcttcacgtgtccaataattactgtattggtcaataaatccttggtcttcaccacaaacatggtctgatacaagtttatcacttacctggtcaagaacttcagccatatctttagaataatgacgagcaccaggaataaccagagtcccaccatcttttaacttaaagcggttggctgcacacacaattcgacgttgatatttttcattattgttccaatgagctacttgccaacagatttcaggaacctcttctaaaacatcctcttccgtatattcggtgtagtcgccataggcctgtaatttagctgctagactttctggagtttcacgtaataaagccaggtctaataattcaagacgctctttgaaggttttcatttggtttcctcaacacttttaatttttatagcttgtttagaactttcaaagcattgacaatatactcttaccgcatcaaactggttggccgctttaagatggactacaccttcgccgttataaaattctacaacaattttaaatgttttcatttaaaccatcctttaatacgttgccataaagttttctgttgagctttgttaacaccaattgagcgaataactggttgagattcatggaattctttataatcagcaaggtaaatttcgtaagctgaatccataaaggaacttatagctgccatgaaattattgcgaatacctactggagcatctttactttcacgaataatcatgtatttaccagtcttaatctttacaatagttccaagataagccccatggtaccagatgtcccatccctcttgagtgggttctgcgcaacgacgaagttcattaacaatttctaacttgttcattatttattcctcacagttcagatgctacagtgattactgcttcaatgttttctgccgagcgtttaatgtcaagatacacattaccgtttttagcgattttacatgacattccgatatcagtaaatttctgaatatgatgttccatcattttgtatccaaaaattcgcatatttccattgttgttaatttcaaaattacgaattccgtgagtgcgtttttctaaaatagcgagatagttactgcggtaagtttcaacctttttaagaacaaatccattttcatctaaaagttttaacatgaagtctttatcttcttccatatcagaagtaatttcgcgagctttacgagttgctcgttttttcagcagttccggagcgttttcctgtgcgtataaagttgctgcatttgaaataatatcctgagcttcacccgtaatgattaatccatcaccagatttctccaccaggccttttttaatcaataccccaatattactattaactactgcgttacctaaatctggatgcacctcacgaacttctgcagctgtaatgaaatctttcttagcaatagtaattaaaatcgcagcagttttttcattcagaacatcgttagaagctttgatgatgtaagttactttagacattttaatctccgtttcagttcatttatttgataggtctatagtatcatgtttaaagcagaagtaaacacttttttgcactctttttcaagagctctaataaagtacttacttaatgttcagattacgaacttcgatttcgtcttcatgggcaaaatcaaactgtttgaattctgtgtcacctttaaatttaaaaatcattgtgaagaaagtcagaacaccaggtttttcttcacgaactccacagatatcatattcaataccatctacaaccagtttgttagcagtcagagcatttttagctttaacgatttcgttttcgattttaaatttcattttttgtatctccgggttgtttgtttcagttcatttatttgatagttgtatagtaccacagtatgctttggttgtaaaccgttttgtgaaaaaatttttgaaataaaaaagggagagcctcggctctccctaaaattactgcatgactgtgataactgtcatgataacacgttgaattccgaacgcaagaagacctcctgctacggcaggaacaacacctaaacccgccagtaaaatgccaccagatactaatgcagcgcttgtgataccaatgaatggactcatttgatttcctctaaatctttggtgtattctgtaactacatcagtagttttccaatattcgttttcttcttttttggctttagcttcttcagcaagtttctttgcttcgtcggaagtcatatgaaaaatgttcattccaactagtttatcaacataagaagaatacatatcaattttagaaagttcttcggtcagttctttgcgagttttaccttgtacaacaatttcacctgaaattactttcttaatgaaatgtgccttggcaaaagctaaacgaaatgctgattcagtttctttgattttgttatcaattcgtttttggacataagttttacgaacttcaacgaagtctttgattaaatcaactacattatcgtaaacttgcagctttcctttctcattaatgacggtaatattctgggaacgacgctcaatcaacccgaagtctttcataatttttgcatggcgttcttcttcattatcgctcaaagagtattcttttcggaatttaactttgaagccaaagccatgctcaccacaagcatcatcccatgtaatgaagcctttatcttcaagcgggtctaagattttactcacataagtttcacgatcatacttatacggaatctcagtgatatgcatttgagttcgtgaagtaaacttatatgttccacgaatttcatactgcccatcaatttcaacgacttcaccacgaaattctgggaattctaccttcggtttagttactttctttccttgaagagcttgtaatacagctttcttaacagaagaaacactatgaggaagaatgtaagttgcataaccagttgcaataccggaaacgccattaagaagaacagtaggaataataggcaaatagaaagcaggcggaatgtgttctttatcttgatgtactggagcatattcagtatctttatatacgttatagaaatttttacttacacgagcaaaaatataacgacttgctgctgccttttggacagtacgagaaccaaagtttccttgaccgtctaacagaggaaagttattattccaagtgttagccatcaaagcacctgcgtcttgcgcagagttttcaccatgatgatatccaaggtccgctacaccgcctgcgatagaagcgagtttgtgaaacttatctttatttcctcgtgccaaatcaagagctcgagcaataacaaatcgttgaactggcttaaatccatcaatcatatttggaatggcacgattttcaaccgtgtacatagcataagccaatgcttcattatcaatgatactttttaaatcacgattattcagttgcataaatttaccatactagtgaatgtagtgccataataacatcagaaatgaaaagcacgacttgaattaatccgaacattattccgtaatataatgctatcaataaaatagcaagggctaatgaatagcccaagattttcttaatcattagtagataacaacacaaatgttaaatatgcacacataccctgagctaaagcttgcgaaaacacactgctggcatctatacagatagttaaaacacatgctactatccaacaaataaatgaaataactcctaataattttgcgatattcataatattctcctcaactatttttagaacctaaaataccaaagtttttaagattgttacgatagaactgcatcacatgttcgttatggaaattactcattaatatgcctgcaaaacaaatttaaagttatcagccaacatacggttcatttcttcaagtgtttgatactcagaatgatgattacgagtaaacgctaaagctaactgtccttttccaaatcccgtcgtcagaggtttcatcttagaagcaggcagataaaatactgtgtataccatattgttatttgcaatagtacgtgcaagctgagaccgacgttgacgaatatgacttagaactgcactgaatccttgcttagaacgctgattacctacataaaatcgtgcagacacacatggattactaaatggacgaccatctaatttacttactaaaaaataaaatccaggtttagataaaatatctttatgcggagttcccaaaaaccactcaccacccttgattgtaccaataacagtagcgcctgcattattcagatcagtaacagtcatgtatttcatattaatttcctctaaattattttctactccaaggccgcatgaatacacgcggccattaaattaatcgtcgcagtcgacgctcaattcccaaaactcttctacggtataagtttcagtatcattttcaatacagaaacgttcattactgttatttgctaaagtagcattaactgtcattttttcgctagtgctcttaagaggtgaaatacgaattaactgatcaccgttatctaaacaaaaaatttcaccaacttttacatctttaaaacttttcataattcacctcaaggagtataaaatccaaatgcagttgttgaccatcccatccaatatgggaaatttgcaccaatgtaaaacataagaatataaaaccaaccactcagcaaattcatcattttacaccattccaaattgtttcaaccacggattttaaaccattttgatgaatatccattccgactaccgtcatcaaataaattccaactacaactgaacctaaggcaaaaatcagcatgaaaatgaataaagccggaaaaatattatcgaaaaaccattcaataaatgtaaaagcactgcgtttacgcttcatattttcctcacataaatccaaagtaaacgtttaatacatcaatcattaaaacgattggaaatatactcaaaactattagtattataactacattccatatagctttaacaatctttttcattttctgttcctccgtagttgatagggtaatagtaccacggaagaacagtcttgtaaacaacttttttaaaaatattcgtaataaatgtgaataccaatcactactgccgaaacttgtgcaacccaccatgcacacgcaataagtacagaattcaaaattttcataataacctcatcacaaaagtaaatgttaaacaaattactggaatactaattaaccaaacaaaacaccaacataatgaactcatagttcaatctcaacgatttccaagtgtttttgttttattgcctttttaacacaatcatggactaaatatgaccatgaatcattatattctccattaactaatcgttggagatcttcacgtgatgataagtaaggttgatctgattcccattttgataaaaatactgcagtaaaaatatctccttcatctgtagttgaagtcgtaaatgcaataaattcaccggtaattttatgtttagcgtaataaaatttaaatttcatttttactcctccgtagctgatagttgtatagtaccacggtccttgtggtatgtaaactgttttgtgaaaattttttaaatggaaagataccatccattgtagttgctttttcttacaaccttacgaaggtcttctctgtcaccgatgaacttcggagtgtactggataacacctggatgaatttctttagtgttgaatataattatacagtcagcgacttgatgatttagaatgggccctagatttattccagaaccgtatggatactctccgctgcatcctgttgttacagaaatccaacgtgagccagtttgatgtgtcttaacttctacacgaagcccacagtattttggatgtgctaaaacatcccacgcgtatgtatatggatcatcgacatcttcttgacctttattaacatacccgcttagccaatctgctacaaaaaactctgcgtatacagcaatacgacatctttcaataacttctgctttatcctggttcgggttttgttttaaagagtatcttgcagtatcagcaattttgaccttcatttcgctagtcaagtcactgttcgatagggtaaatgtcggaatctgaaatagtctctgtaaacccggattcgttttctgcatttagactttcctttttaccactgagataagcgttatatactttaagagtgccgtaataaattcggtcattttcatctaaagactcgcggtcaagttcatcgagctcctttttatccatgactataacatcattacagtaaagaaacccaagtttttcgtgaccaaactcaaatttattacagtacacaatattagcgtgatgatttccgtgcagtttaatctcttttatgtcggaatcaccgatattcatacaataaatcataatttttccttaaaacaaaagggccaaagccctttattttacttgaattgtgcaattcttttctctagacattcagcataagatttcattgagatgaactgtgaaagtagcagttcttgctcaactacactaactgttagaaactttgcgctttctaaaaatttactcagtgcattaattttgagcattaattgatcgtattcttcttttactcgtgcttgataacctaacataattttccttagttaagggctgaagcccttatttaaattgttcagtaacgtcttcaactacttcgtattggcaggtacgcattttagcgtcgttgtaatcaatcggaattgataccacatcgcgaggatgcactttaacttttacgactcggctggttgaactgccaaagtgacgaatataagatttagaacacacatgcagaccacgagaacaagtttgtgtatcatcgtcattcacacgagtacgtggcattttaactactttacccggactgttatcaaaggtatttgagtgacagtcaaagtaattgctgcgaactactttccaagcatagaagtagccatcttctgtaatttcaatatcgtttgctaccaagaaatcaaagagtcgagataccgctttttggcttgggttttccaacagattttccaagaacggaaaataaaattcaaagttttcgcctttttccatcgagtcaagaatacgatcaaccaaaccagaccgcaattcaatattttgatagaacaagcttccaccttcaattcgaacatcgccggaaatatatttttcaacagcgcgacgaacattaattttttgtgccgcttcttccaacttatccgctacaagcagattaagaatttcctggaagtttgaatgagtattaggagttgcgttataagttacaccgtcaacagtaattgaaatgaattttttagatgcattccaaataatgtcagatttagcaactggagcaataactgcatcactattaactttaactgtaatatcaccactaatagtaactttagggcgtttagcttcttcggcatttttcaaaacacgacggattgtgtcaaccgatacaccttgccaatcagccaattcctgttgggtgtaattaccacttgaatacagtttaacaatttcagcttgttcgtttttggtcaggcatttaatattgtacataattttcctta

SEQ ID NO: 9 - DNA, 167522 bp, artificial sequence
  BP1151
ttaggccgcaagggccttcatagttttagcgatttgagaaacttcatcatcacttaaagagttgcgataaccgatgaagtcggaaacaatgcggaatttcttggtaaactcagcaaccattttatcactgttttttgaagcattatttgataatacatcaaaaagattagttactgtccagatgtcatgaccgatggtatcttttccaccattaaaatatacaccgcgcaatgaactaactatattagcgagtcgtgcatattcttcagaaacttcatctgtactgaagtacttcatcataaaatctaactcaggatacttgataattttatcaatatatcgttgagctgaacttgaataacctacgtacttatcataatctacatcatcaaaagcatctacatataaatcacgcaaagcttcaaaaatacattggcactgaccgagttcttttacctttttctgtaaaagcggacgaataacataaaattcattaatgccaataagattagccatacgaatcaaaatattcatagatggatgacaaagagatgtagtaccatccatagagaaaatatcagaacgatgcatatacgctacataaccagtaatttcatctgcttctgatgtgagcgtaaataattcctctttttcccagcgcccgtctttaatttcaaacttaaatgctgtagcagctttaggacgaggagctttacttttaactacctttggaatatagcttttaactaaagcttcgatttctgacaaataatgaatgttaacttcatcactttcaaacatcgccataatatcagggagtaaatcaatctgcgattctacttctgggttaataaacagaaggcgttcattgtgatgaatatttaaagtgttattaaattcgctatcatctaacgctcgtgctaatccacgaacaatattaacacgatttttaatattatcaataacgatattaatttttgttgtattaataccaaacagacgataacttgatgcaacggctgaagtttcatgactttgcttaatgcgcttcagtcgagggtcaagatttacttcatacacaactcctgcattacataacttattgtcaggttcaaacatgctctgcatctttttatatgacagatttttagtcgtgaatttgactgaattactaatcatataatctcgagcagaatatcccatcttcatcaattcacgatatgtgtgacgaggagatgtagattctttaaatcgttttacatcttcattaaatgctttctcactgagttctttaactcgttcaataatatttttacgagtacgatcatccaatgaaagagcttcgcgtgatggagcaatatcaagtgaacccattggaaacttaatgtaattcacttcattgcggatgcttaaccagttacggtctctaataacaccatcgataggataaacaataccaccatagatagcatacaatccatcacgatctggccagtatctttctggatttacgccgtaatagtcatcaaaatccggaaaataatcaatttcgcggtcaagaccattaatgatagccaaatctttgaatggtcgcatgatataagaaacttcataagcaaagtttctaaagtctttttcttcaactggaactacgatttcaataccagttttatcatctggacccatttcttttacgaatgtaggtttaatctgtgggccatcaccatccatgtaagctacataaccacgaatttcacctttatgatacgaagtaatactaaacgtatcagtataactaaacggagatttagaacctaaaccaaatccgccaataaagtcattagattcagctttagatgaactgaagtatgaattatacaacccaggagaattatcatcaccttgaatatcaaaatcactcatacccggaccaaaatctcgacaaacaaatcgtgggtctaaacgtccaggaacttgtatgataaatttttcaggatttccattgagagcatgggcatcaatcatgttagtaatcaattcacgaactactgcgcgaatcttgtttgtatacaaatcagatgacagaattttaaatactttaggatttgctgcgatgctaaatgcttttgatttagaaccattgccaagaattgtttctttttcagtggtgataatcataatttcctcattaattcatattacgtttaataacttcagcaacttctagcagttcatctttagttgcggtgtcggattgaattttatctctaatatctttaaagcggtttttaaattcttcggcttctcccatatcgaaaaagcgttgaatgattctatattctcgatgaactgctttatcaaaaagttctaaatttactttatatgatttcatttcaatatcctcatttgcccaattaattataccacatccttgtggtaaagtaaactactggctcatccattctttacgaaggtcagcattatctcccatgagcatttcaaaaagctctttccagttctcaggaagtttaacaacatcatatactgggttttgaatcatctcacgatattcagatttttccaaagagccaagtcctttaatataacggatgctatgtttaggtagagcatctttggcactctcatattcagcgactgtataaaaccattcttgttttttaccaatctgagcgatgattacaggagttttgacaaaacgaattcgtccttgctcaaacaattctggccaattactaaaaaatccaagcagagaaggataaatgcttcctaggccatcatggtcagcatcagtcataatagcgatattatgataattcaagttttcagctttttcaccgagaactaatccagtgattgcgcaaatatcaaatagttctttgtttttaagcatatctgcataagacataccccaactgttgagaactttaccgcgcaatggataaccaccgtgaagttctttatcacgaacatcaataagatatccgatagccgaatcaccctcagtcaagaaaagagtagtgtcagcatctttaccacaaagattcgctttgatatgtttatgaaccttagctttagaagcctttttagctgctttagtttctgctgctttttctgccgccaatttacgagccaaagcagcttcaataatcggcattagaattgcttcattatttagaatagcgcgtgaaatctttttagcatcaagctgaatatgactacgaatttcgccaaatggagaagtcaaacgctctttagtttgagaatcaaatcgcatgtttttcatatcacggacaaacataacgatagtcaaacattctttaacgcgtgctttagtcacatcaattttgaacttacgtttgatttgtggaataaggtcttcacaaatatcatccataacacagtcaatgtgatggccaccattcttagtgtgaatgttattcacataagttaattgacgaaaaccatccggtgaacgaccaaccgcaatagagcaattttcttgttcttgaacgatagcatgctcatcatattggcgtgcatatttcttaaaattgccctgaacctttttaccattaaaggtaaattgaatatcaggataaactactgcaagtgtctggagacgatctagtgtaatgtcaagataaacttgggacagctcattagtttcaaatgacataaaatcaggaatgaaagtaacgcgagttcctttccattttcctggaatagtttcccatgatttattttccatgccatttgaacaacgaactacaatattattttgaccatcaccagtttcaccgacaaacatcacagaaaaaatgtttgtcaaactagaaccaacaccattcataccaccggtgacgcgttctttatcatcaccgaagttaccacctgcttttggaatagtccaggcagcaacaggaccaggaatttcttcaccagtaggtgttttgaccatcgcttgtggaataccgcgaccgttatcttcaactgttacttgattgtttttaatagtaatattaattttatttgcgaatttaaacttagtacgaataccttcatctactgagttatcgataatttcatcaataagcttaacaagaccaggtacatactgaacactttcccatttaccaaacagaaagcgctcatgcatttcattagcagaagagccaatatacatgccgctacgctttttgatatgttcaatatcgctcagaattttaatttcattcttaatcatcacttatcctcgtttggtttcgggaatattatactccgataatcataaagctaaaggcccgaaggccttttatttaaaacgaatagtcgaatccttgaagaatagtccagaacatactgttccttctactttctgcccagtaggtccaatagcacgaaatccagtatgctggaaatcattttcagagcaaccgaaccaattatatccagtgatttcaatattagtaaaaccacttgaagacaaaactttggttgcattatcagcatcagtacatcctattaaagacactgctaatactaatgctgcgatagaacgattaatatatttcataattttcacttaaatttaatggcttgaagaagactaataattctcaagcgacttccttcatctttaactgtaaaagaaagagggtcaccagacttcatagtaatagtgcattcaaaatcaaaatcttcggaaacttctttgaagaagtcaaattcttcatcataaattaaaacttcactccgaagactgtgaagagtttttccgtcatttccagatgctgtactaatcattgtaacattattacctttcatatcttcaacgataaattcgcttgtagatattacagcattaatagaaccattcctataaatagcagaaaatagatatttcttttcttcaccttcgcgaatgcgatatttcttaccgattttaaacataattaccctttaagtaagtcgtaaaatccgccattcacatgcttaggggcagagactaaccgaatagcaatccgatgacaatcaggacatacatcagtatctctttcagaaattttcttgattttttcgtattcttttgcgcagtcttttgattgacatttataatcataaagcggcataattattccttaaagtgagctttcaacatctgatacaaggaccatgcctgttcatcattttcaatagtaactttcattacagggaatttagattgatcagttatcggtgcagattcttcctgctcttcagctgcctggtatggattttcaacttcattaaagaattcagcttcattcgatgaaagccaaataaaatcttcatccaaaatatctttaccagaagatagtactaaatttccagcaaatgacataattttaataggacgcccaagagcatccacatctaaaattttaaaaggatgcatacctaaacggcgtgcatagattccgttatcagtatggtctttaataaaattttcttgagcttgtttatttttaaattgataccatttattaacttcaaatttaatagccattaataaatttccttccagtaagttgtaccatcttcagtgatttcacgaaatacaccgtaaattggttgtttatccccaaccttttcatacacataaaccgaagtcaagtgagtaaacttagcagtgtgttccttttgaactactaccaaatctggatcgaataacacatcttcaaattcgtcattagtgcagttctgaacaattttacgtttcattacaatttcctcgttaattgaacattggagcgatgcgtttcagaagagtagcagcacctttggcaaattttccattttattctccaaattattttctatatcagtagttgatattgatatagtaccataatcaactactgatgtatatagttttatgaaaaaattttaaactttatgcatagcgagctttgctgtagtgtttaatccaactttcaggaatgactttgtatgttcctaaaaataccgcgttgtataacttaacgccatcttctacccattgatcagtaatgtatgcacacatagcgcgagtacgctgaggaagtggttgtccaccttcggtaaattcaaactcataaggagcaatgaacttgatagcttgaccaagtttccacttaaagtctacacctacatgcgaagtatcaatcgtttcaattcctttagcaggaacagctttcaaaaacgcaggctcaagaaatttccatcgaacataaccaaactggggcttagacattccatctttagcaatgatacgtacttttacttcagaatcttcatctttaacaccgtgtttaagctgaatgcttacaacttcgaccaattttcctgctgctttagaacgggatttatcagatacacgagcaatttcaccgatattaatattcataattatctctcacttgttaaaaagattttatactccacaggaccattatactctggtcccaagagtttgtaaactagcttacacgaacattaatcactgcgctacgaggaactacagagtattctccagcatgaactacgttcagaagttcaacgccatcttcaatccactggtctgttacccaaccacagataggattatcaaaaggacgacggatagacacagcagcacacaacaggtctgtagggtcttgttcttcaacttcttggaacaggatgaactcatcttcataaaccaggtttttctttattttgttattatctaaccggcgaccgtggatgacgtaagatttgtcaaaccactcacttttggcaaattcttcaacaataaattcgccttcgccaaaaacatcagtcagagttttatgaccagaaatcaaggcattagttttaattttaggttcaaccagtttgtaggttttgccgatttcaatagcggtagtcataataggttccttaatttccagtggtttaacagggcatacataagtgcttacaacatcaaaatcaatcagtttagctaccggatttggtatgtattcaggattataattaaatttcataattatctcatttcaataaaatctacgagttcagcatgcgatttgcggaacattacttggtgcccaccaatgataacttcatcttcaggaacttcgtatacagcgagataaaatcctttagaagataattcttcccgctcttctcgtgtgaaccatctcatcatatcatattcactagcgaaagcaaaatgataaagacctataaaccatcctggaatatgatattctactccaacataatctttcttgaacttagtattaattactatattagcgtttttaactaatagtttatcttcgtgtggtaaaggaattcttttattattatcgctatgatgcataaaattaggtctgtcataacctacgtgtaatagccactcttcgctccatgaatctattatactcctgtacggcgttatttgaacacaaagatttcgacgtattgttatagcatcttcataatcaagaatactaaacgatgattcaacacgataaattttcattttattatcctcagtagctatggtgttataataccacaactaaccgaggaagtaaacaactttttatcgttttgttggaagagatagaggatcgcaatcttcctctgatggagcatcttcaagacccatagcatatcgcaaagcgtacttcatcatcaggatgtctttcgcgcagtcatgaatagaatcatgcgcaacgaatccatctaaagttccttttggaagaggacacgtggtcatatcacgaacaagcagaagtgcttcaattctggtacgaatatcacgctgattccagaatttacatggttctaacttaaatgtgtcaagctcattctcagaaacaccattaagacgttgaatatcacgaatgagatcgactaaaattggaaaatcaaacgacattccacggcaccagccttgagatttccaaggatcgatattatgtgcattgatgtaatcattaaattttgcaataccatcgatggtgcttacatcttcatctgatggtgcaatattttttcgagcttcaggagactgatttttccaccattcgatagtgcttttagtaaaaagacgatgtcctttttggctttttaaatcaaatttgattttaatgccgcgtgaaactaattcatcaaatgtttcaactacttctgggttagggtcaaaagcaattacagctaaatcaataacagctgctttttcaccacttcccattgtttcaaaatctataataaaatcaaacattaaattttcctcgctaaatcgcgaatttggcctacagtatagtcttgaatataaactttattaataggttcatcaataaattttgccatagattcaatatctttttgcatctcttcaagactgtatattatctttaaagctttttcgcgaatagtaatattttcaggaccagaatttttctcaatgacagctttaacatttgtcataagagatttaaactgacaccaacttaattcaatcattaataatcgccttataaagatagctaatttcacctaaaacataatcactgattgtgacagttttcacttcaccacaaaagaattctaacgcaattaaatctcgttcaatttcttctaattgaagcatcaacttactagattcaatttttacagtttcacgatttttactataagctatttcataaatttcgctcactttatcttgaagcagataaaactggtctttagttatttccacgaatagcttcctcaaatttaattagtaatttacagacactttcatctagtgtaattaccgtatctgtattactgtgatatgattgtttttcaattcgtttaattgctaatatagtatcacttataagataaagcttatgaaggagctcagctcctgttaccataacattaagattatcttgcttattagtatgcttccttataccatctattagacgatttaaatattttgaattgatgttaatcatatagcctcacacataaaacacatcataacgaccacgggtaacaccaacataaagaagttgttgggccaattcagcatctgcataatgaatacaaggcgtataaatgaaagcacggtctacagacataccctgcgctttatggaatgttgatgcaggaagtgctttcactttactaaactgtgatttagcatcccaaaaatcactccatggagcttttccgcctttgttccaatttttataagtttctgctgttttacctaaaaatagattaaacttatataactcttcatcagatgaaattattttaatcttttcacgataatattcatcatcgccgtaagtttctactgttaaatcccaatgacgaattaagtattccccaggaacaccacgagctttaacaaacgttgatgtatactcagcttctataatacgaactaattgtccgttattaaaaataatttctgatacaggctttccatcaattttatatgttttaattaacggttcctgcattacaataatttcaccgacaataaaatctttatcagtttcaaaaatctttttacgaataatgctatttaacttgtcaacagatttattcgtaaatgccattacgcgattttcaaacaaatcatctagtgattttacgattgaaaaataatttaccataaaatcgcgtaaagcggtatcaccagtaaatccacgtactccatgcccgtcaacaattttatcataaatccacttaccgttacgaacgtcagtagctacatcaataataggagcattactgcgtttaacttcagtgagttcacactgataaaaatctttgtgtgtaaagaatggactgatataagcagtgttttctcctgggtcaacaggtctaatctgcttattatcacctattccaattatagtacaccacggcgggatagttgaaagcagaattttaaatagctttctatcatacattgacacttcgtcgcagattaatactctgcatttagctaaatccggtacttctttttgttcaaaaagaacgttttcttcatatgttactgggttaattttaagaatgctatgaatagtacttgcttctttccctgatagttttgaaagaatctttttagccgcatgagtaggagctgctaaaataataccagtttcacccgtagatattaaagcttcaatgatgaacttagtaagagtagtcttaccggtaccagcaggtccattaatagttacatgatgtttcttttctttaatagccttcataacaatgttaaaggcatttttctggccttcggtcaaatcatcaaatgtcatcgtaaattccctgcaattggtatactaacaatacgcccagtatctaaaattcgctgatataatctttgtgtgtctacgtcaggcttaacatgtttaacttctattttattaaaccaaaatttacgtggagtctcaactaatcttggaattcccttacctaaagctagtcgatactgctctttaagagtagtaaatactttatcagcaatcttccattcaaaaaatacagcaggacgatgttcatcaagcggaactggcgccgtaaatccgtctttgtctcggtaaactatcgcatatacataaaccatattatcctcggataagtttaaaaattgaacaatttagcgggtatcctcttttcagtttaagtttatcaataaaagacaagttttgataccgctctacaccttgaataattttatcacacatatcatattgcatttctgcttctgacaactttttcacaattttccaatccgagcctttaagaagaacgttcagtttaacaacttcagcgccttctgctatgcgagaaccatcaatacgagctttaagtgctataatccttagcttaatgtcagaggtctgttttgatttagaaagctgagaaatgtgttcaattcggttttcacgttttttctgtatagctttaatttgattataagtctttttgattttagcccatttcttttcatctaaatttagtttatgaacttttttcgcagatgaacgaccaattcgcaaagcaaataaatcacgcttttcaatcaactcctctaaagtataatcagaacgaaatgtattatactttttctttactgcaataacattccctttaatgtatccaacgttattatcaaaacgttctaatgataatttctctccttcaatacgattatcaaaaggttctcctgagtaggcacaaactttttgatctaaaatgttcttaatgtaattgaagtctaagttaaaatctttagaacgtctttttgcagatgcctgagtatgctctagacgacgtttaattttacgaatttgattattagacagcttcatatttttctcacatcttacggacggttaactacttatactataacatttttaccttaacttgtaaacaactttatgtaaaaatgctttaaaactttcatggtataatgaatctaagtccttccattatagattaaatccttcaaaatcaagagtatagatagtgtatgttgaatactttttgtactcatatttatctgcaattctaaatacacttccagctggtatcattacttcttgttcatctgaaactaattccatattacgataacgatggctatccggaaacttaaagtttggattgtattctttacaacgtagagcttttatagcatactcctggaaattgaataccataggagctttgaattcaaaaataacttgtgtgttatactctaaaccggaagcaaaatgtagagctatatttttatcatatgaagctgatacgactttatcaaatgtaataatatcaattccttgatttaatacttgcttagtctcagctggaacacctctccaaagaggtttatcgtttggttccaaacgagatttgattatttcatttaaccaagtatggtcatctggtttattagtaatacaatgaattaaaagttcaatttcagataaattaaacccttcagaaagtaattcttcacgaatagaagcacgcaccgatgcatccattgattttattttaaaatcttttagttgcattactgagtatttcattcaactacctcaatatcataaactttaaatgttccaaatgaatcgtgtaatttttcttttgaaatagaagttattctatactttccaattggaatcatccattcttgttcacgcacaatcatcattaagttatcagtacgctctgaatctagcccatcagtatcttcatacgtgtacttaaactcagtattaggagaagaaagtataatatcgctgatatggtcagaataattaaaagctttatcagtttttaagcgaaatattatttcagtgaaatactcaacataagaaaaaccacatgctgtgtgcaaactagtagtaaatgaatctaccctattcgttgaaaacacttctccaacttgtaaatctttaatgagttcttttgtcgattttgatataccacgatataactgataaggtgatttagttaaatgctttttaacgattttattcaactgccgatgaagagcttcattctttttagcttccatacattgccaaagaattgactgctcaaagtcagtaaatttttcacagacttttttatacatatcatattgaaaatcaacgctttcagcttttatagataactgttcaacatctgcaagattaataatcatgatagcctccgtatacttcagaagctatcatatcatcgttagaaaggaaagtaaacaactttttgaattattttgcccagggagcccaaggcggagggtcaagatggtatgaagctagttcttctagaagagcatctggggcttcaattccataattctgtaatactatacggtattctttcttataatcactagaatcattctggatattcgtagaatgattatcttctaacatctcaaataaatccatactaattcctagcgataaaaaccaaattgacgattagcttcaataatctttctttcttcttcggacattctccaacgtagtccaacatcaaaatgagcccagaccatcttaacaaatgcatttatatctttaatatcttcaataatgaatgttttacttttagaaggttgactcactaatttaactttatcatcttcaaacaggtcaaaaagaccatattcatgagctcttttatagcctttaatagttaaagcttcagaagaagaaaacggtgaatcagtattctgtaaaatatcttcagtatgctttataattagaataacattttctggatattttctttcttttatatctttaattaaaagatccggattttctgctaaaggaataattaatgagcattttttaccaagagtatttactgatttaccttctttagacatgaattctactgaataatgttttgctacttcaatcatgtgatttccttttgcctactaatggaccatcgggaattttgttttcctggatatatttctcattttcttccatcattttactgccaattttaagaagcaaatccagtgcttcatttgcttttgctttagcctcttctaacgttatatctttgttcatgatttatcaccatagatgtctctcatcaatttaagcgctgagcgttctaatttcttttctttctcagcactaatcattgatttcatccattcttccgattcgttctgcatttctttatttgcttgttcaacccaaccatcgtcaatatacattgagtttggtctattgaaccattcaagaatcttcttgggagctttcatttattttacctaaaacaatagtaggagcatcgtcaaatttatgaatttttagtaaatttggatttaacttattccataaagaggtaataaaatatgatagcgcactttcgtccgtaattataaatttatttcctttatctattttccaatcatatattgaatcatatgaatagaaggataacggtttattattataatatgcttcactaacatcaatatagttagatttagtaaatgcttgaattgccataaacggagaattttgtacagtttcaataattccgatctttttaagttttatttcaacatcttctggaattggcattgaaataaaatcttctactagatacatgttattgtcatatcttttatcaatcattactgctacggtaattggaacatccttgacaaacgccatactaatactattgatagacatttcaaacaaaattgcttccataattttcctcaatcacaagatgtagatgaacaactagaatcacaagaacttccacatgaatcacctgcccatacgtgaacaggaacatttgtatcatatgaatcagaactagactgtgttttctgtgcattagatgatgtagtaggtgttgaccagcgccaaggatttttataatattcttgggcttcttcataagtcatagtaactgcttctactgttccatctcccatataaacatattcaactacagttaaaggaaggtagtcatttgaaataggaactacaccttccccaggaactgtagagaaaaaatccgtaaagaaatttttaaaccaattaaagataaacattacaaaaagcctctttgaaattcgactctttgaaatccaccccagtcagtatatcgcatttcagcattgaactcgactgaaccatctgcatgcatcatgaatgaatgcgtgacgacatcacaatcccagcttttcataccccatttatcagagatagctttatcaagaaccttctgaagatcttcatttggtttaatccaacgatttaacatagtgctctcctctataagataattctattataccatactcattttggaaagtaaaccatttaaatgaaaaaggactcccgaaggagtccttgaattattaaccacctatttctgtgggagtaaacattgcagcattcttagttttccaagttgctgcatcagaaactacagtagaatatgccgccttttcagaaggaaagatctgataatgagaatctgcaatacgatgctcgttagaatagatttcaaatggaacagaaacttccatacctttaacttctttgccttcacccgctggatgagtaaaggtcttgatgttaatgaaaccacccataataaactcctttattgtttaattacaggtgtatttataaaccattttcaaatctctttatcatgtttatataattttcgtcaggataacctaggctaactgctaactttctaaaattgacatatttaggtttgttgttattaatccataattctctaagctctttttcataattccatttaagttgatttctgcgtgcaattttgcttaaagtttttcctttagcttttaaagctttttcagatgactgttttaatttttgaatatttaaaacttcttctatagataaattattttcctttgaatatcttatgcaaaaatcttttactacggctattaggcaatttttgtgagtacctaaaatttctggattattttcttcaactaaaattccccaatatcttcgatagcgaggcatatcccttgaaatccagtcattataccaaaaatcaaagttggaatacatgaaagattttcttttgcgaagagtatcttggtttatccattgctcacgtttatcagcccataacttaatagtaaagtctttctctaagtcagaaagcttcttaaattgcgagctatttactgaggtcattctctggaatgcattcagcaatccaaatcttccagttgaacataagagatagtgaacatatatgtgttgatatattgggagatatactctattccaaggatatgttttaaaatcactgtactcaggaaatgcgcatttaggaagtatatgatgggcttctgttttagatttaatgtgagtgtttaacttatacttatctataatttttaaatactcatctaaaagttcccattgcgggaacttttctttaagagcagatttgaaattaatatccattatcttgacgttcaaaattatgtttgttcttcagataataaagtttaaagatttcttcagccgtaagaccgaggccttggaacatgttcagaacgaaatgaagaatatcaatcatttcgaatttaatttccaactggtcttgtggagacaaatcagtaatcagagtttcacgtcgttcaccatgttgagctttccaaggcttccatacagcagatgcatctttttcaccattgctcataccaccaagagaagtcaatagttcgcggaattcatcatcaatataatctttctgattacgcagccaatcaacaacttcacccgcagtagccaaatcatcaggatgacggttatattcaggtttatctttagctaaacgaacctgcagagatttctgcatatcaagcataacttgcaacgggtctttttcatcaccgagaatatcccagtattcattttgagctttatcagcgccttcaatcagttgtgaacattcattaaagtatgccattatttttcctttcaattcatgggttagtagattaattatacaataaatatataaagcaataaggaggacatatggtacaaaaattaatggcacttgttaatgccatcaaaggtaataaaaagcgtatagcttttactatttctgctatggtaggaattttactctggaactttattttatcacctgttgcaattgcacatggtattaatattccagtagttactcttgatacattcgtagatttagcattcgctttagttgggttaatttaaatcttagcatatttagataaccgcattttagccatcaacccctgagcaatattatttttcatatattccataatttgttcagtggttgcaccttcctttctaatcatatcattaacatcttttgatttccagggagatttatcccaaaacataaccctttctcctgcatcaactaatttagtcattcgcttaatagtgtcaggatgacgaggttcattatctaaaacccacactcgtctatctttaaatggaacaacttctaggtctaattgaccacccgtaatagctataccattttcaataaaaagtgaatctataggtccttctagaacatatacatcaccatctttaactcgttcgactccatatatttttgttgcctcaggataagctttgatggtgatatatttttgaggagcatctttctttaatgcacgtccttgaaaagactcagcttttccgttagcattataaattggaataacaagacgaggctcagaaatttcctttttatatgttcctggagctatactattaactaatttaggccattcggttgtaaaccaaagatatttccatttatcctttggaatacaacgagcttttacatattttataattggatggtcttccgccaatttatctaatctgatgcatgacggaagagatttaattattttcttctcaggttgtttaggaagttctttaggtttttctactggacgacttttacctttttcttttcttatttcaaagatatactcacgatataaatcaggttcaaactcctttaaatatattccgattggtgcatgatagttacagttataacaatgaatatttccttcattattatcgccataataccatccacgggctttattttgatcggtttttgaatctccacaaacgggacatctaaaccgtaatttaaaagttgaactattatttacttgtgcgaatttaggtaaatgagccaatgcacggtatgcaaactcattatcaatccaaggtattgatgacatttttactcttctttttctttagattcctcttttttctttttaggaatctgttcaggacctttatttactacagcacctgacgttgttccagtggagatattttcaggattaccacctgaatctccagctaccatatcttctttaataaattctttatatgttttcatattaacctctattcataaaagcattaaaaatttggtcatcaatagaaacatctactttagactgtttttctgatggtaattcatatccacatattacaattttgtgatcaatatcaaaatacacagaagcaatatgattaatgatgttttcagtaaagtctaaatcaacatcaatatctttttgaccacagcccaaaggataaataatgcgagtaattcgattatctttaacaaagattccaccgacatactctgtgctgcgtttaaagtctacacgccaacgaaatgaaaaatattcaggctctttatgagctctgctcataggacacaacgagtaactagaataagagatgtcaaatcctacgccttcaatatgagccaaagtatcatgattaaaccaattataatcgtacgccaaatccattagattataatatgtaaaaggcaccggattaacgtcattaatcacaagcatgtaattagcaactgctataatttcattgtttttaacgaatacaaaccgtgattgatgcgaatgacctggacccgcgttttcacgattaatgatataacactgggcacctttatatttgtatgtatctttgcacttgtgcatttgatagagcattattcacctaccacttcagcgatgatatttttattattaaagtttttatcgcaatacagaacataattatactgcattacaccaccagacttaagctgtttttgcactttagctttcatttcggggcgatcgcgctcaacgatattcataatatctgcttcaatttgagtttcaacctcaatctgatccgcagtcatagaccattcgcacaaatctttatcatagcctgccatggcaggttgagcagcgcaagaagctaaagcaaaaattgcagcaaagataaattttttcatgataatctcctcggtagtttatgtttatataatatctcaatttccaacaaaagtaaatagttattttaaaacttctgcgtaatcacatgttacaaactgtttctctagcttgacgattttacgaaagtatcttttgcattggcgaatctgcctcttcgtaggacgtacagcaaacttaataaattccactcgaccaaatggaggactttcttctgctggaatatctaacaccaattcccacgtatctgcaacaagtgctttgaattgcgtatttttcctgacattatacggagtaggtttaaataaaacaatatgcatattatcctcggcaatctacttcacatactttcttgtcatcaatgaaagctttaactaatgctttattaacttcagcatactgagtagtaacccattgaacatcatctttcatcattgtggtttctttagtaaacatgctttcattcttaaaccaccccataaaaactacctttaccaattccataacaatctcctcatttaaccaacaagactactataccatagtcttgtcagcttgtaaactaaaattttaattcattcgccaaagcatctaactgagctcgagtggattcatttctttgatagcgattctgctcagcctgaatctgttgtgaacctgctacttcattcacttcagttggagtagaatcttgatcaatttctacccatttttgatttcctttttgaacacccatcaaaaacttattccatttattcttatcaccatatcgtgatttgatttgcttaatgagttgttgttcagcagctgctagctcctcggtttcaatgaccgcaagcataaaatcggctgttgctggaagaccagcagattctgcgatatcgctcatgttaacatcggaagagtcccaagcttgtttgccgacctgcgctgcagtccaaagaacagtttcggtttcaacagcaagagcacgtaattcctcagcaatggctttaacagttgtgtaactattttctgagtaaactctaatgcggcaagatttacaaatacccagatagtcgacaataatgattgttggaacaaaattcttcttgagcttcaattcgtttaaaagtgatcgaaatgtattagcgtctgctccaccagtaggatactgtttaacgattaaacgaccaagagtagatttctcacgccatttttccatttttcctttatactcagcgtaagaaatatgcccatcatcaatgtcatcaagagaaacatcaagcatattagcatcaatacgcttagcacagacttcttctgccatttccatggaaatgtaaagaacattatgtccgagctgcaaataatctgctgccaatgaacacaatcctaatgacttaccaacgttaacgccagccattaaaacgttcagtgttccagtctcagctccgcctttagtaattttgttcagaattctgagtttaaatggaaccttacgagctttattcatataagatagccaacgtgcttcatagtcatccatccaatcatggccaacgtagctatcaaatgaaattgataatgcttggcgcatgatgtcaggaatagcacctacatctggcattttcttatttcgtttttctggaggaagctcagcattagtttgaatttcgattattttagacgtagcattaaacatcgccctttgctgaacatatttttctgtttcttttattaaccaactgtggtcttccggagaatcagctagttttgaaataagtgtttttacaccagaatattctgtttcagtaaatgaactattttctaatgcaacatttaacgcattaatagatggaacgctatgatactcattgacatgagatttaattaatttgaatgtatttttagctggaccactttcaaaatattctgaatccatatatggccaaacttttgaaaaataagcttgatcaaatatgagatgagaaagaataatttctaccacacttactccttaaaagaatttaaattttttctttgaccttttattaaatgcatcttgcagttgcattgtaatacatttttctacatgaggagctaactcagcttttctttcttggtcaagaacagcaaagtccattacaacctttccattaacccaatccagttttgttacatatactatatgcgtagaaccatcttctagtttaatgacaatctcctggataacattttccatagcggatttaattatcttaagagattcattaaaaagacgttcttttctttcttcttccccctccgaagagggggattcatcgataatttctagatctaagtctaaatcatctttattcattaaattcttccatatcacttaactgctcgaggtcagtttctaaatcagcagctgatttacttttactttccggagatttaaatttttcaacctttgagttaatcaattcatcaacttcagcttcaacaatttcattactatcaatagcacctaactgataagcacgtttaatagcatctcggaatggttgatgcttaaataaaggaccccagaatgtagtgcagttggtatcttttgcgcgccaagatttttcttcgcgaatcatctcgccagtttcttcatcaagaaattcacgagcataccagccatttttaggttttactacaaatcctaattctagagccatatctaacaatccagaataaggatcgataccaccatcaaatttaacatcaataaagaatttacttttttctttaacggtacgagatttttctacatttagaacaaattgatacccctgaagatcagaaccatctttaatctgacgcttaccgataatgaatacggtatcagccgaatacattacgcctgtaccacctgtcatcacggttttactaaacatttcaattgtttcaattgtatggttaaccgcaacacatggaatatttttaatgctaaagtaaggagtaacaatacggaataatgacttcagtgatttagcacgagtcatatctgccacagatttttcattcaaggcatcttccgtttctttcttagaagccatattaccgattgagtcgatgaatacaataactttttcaccgcgctcaatagcttcaagctgattcaccatatcaattttcagctgttcaactgactggattggcgtatgaattactcgttccgggtcaactcccatggatcgcaaataagctggagtaataccaaattcactatcatagaatagacaaaccgcgtcaggatatttgtttaaatatgccgcaaccatagtcaaagacatatttgatttaaagtgtttagaaggccctgcgaaaatagttaaaccagactgcatgccgccatcaatcgcaccagaaatagcaatattaagcattggaatttttgtacgaattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacaataaatttaggcattaatcaactgctatcggatgaatagcattaaacttatgaaatgcttctgatttttctttgcgcgaaacacacatgcgaagaacctttaatggctcgtcttcttcacccaacgattttcgtttttcgatattagaagttttccaacgagcttgctctggaaactctctattgatttgctcaagcgctctattatgtttagaattactacgaattgaactacacccgccaggagcttgtgcttttccagatacaaccagatatttgaacaaggccaaatgcggataaccttgattaattaaattgagaaatgcatacatatcttcgcataaatcaatttttccatacccaatttgttctgtcgtaagttttccgaggtcataccatgtattcgtaaatccatatgaattttcacgataattaccccaagatgaagtaattttaaaaattggtagacgagcatggccatgataatacccgcaatccatggcatcctcaacatattgaatcaattcatagaactgttcacgagtcaattgattgactttatctacacaacgacggtcatctctttttcgcattgaactcatacgaatagtagtatcatcgtcaatcatccagattcgttgacctgcatacatatcagtaattgctttacgagtaccggcaattccgtttacatcatcaggaatagttataattttagctctagacccataggcatcataataagctttttcttcatgttcacgtactacgatatgaggttcataatcagtcggaaacatatcaagggcagaaactgcccctacacgttgatagctcggaattacgaattgaatcatttaagtgccttacatttgtcaaaatggtatcttgtcatatttggcccacgtccttttagtccgcaatgcggacatattttttctatcaaattatgaggttttcctttacgatttttagacatcgtttctttaattattttagctttttctacgccaaaaatttcttcataagttttaccagaattttccttggctcgatttataattccatatgcctgctcatttttaccatacattggattaccttcgcctttcattcttttagaatgatcaggacgcttgattccacgaaaggcatttccgcacttatatctttcttctggagatagttttttaccgtacattccatttaatttgcctggaaaacttcctccccatgcttcattctttaaattatatgaatccggacaattagcagcatctaaacaagttaaaataatttcttcaacctgtctaaacattggtccttcatataatatttctttattaaaggattttattccatatttctttttagcatgttgccaaactacacccgaaccatcataattcgggttgtgaccatcatgacttcctatataccactttttagttttaggatgtttatacttataaacatgcggcacatttacttccattttccagtataatcctttttagcaatatgagtctcaccggtgttccaccaatggtcaactaaataaaactgattttcgtacacatgaagacttccaacgttccatataatagaacctgctttatattgccgcgatgggtcgcctgcattcaaatcagatactaatttatctagtacgtatttttgccaagcataatcattacgatagcctgcccagcaatcattgcttctcatgctaacaaccgcattgactttcttatcacgaatcaggtactgtactgtattagtacacatgaaatctgacataccatctttattgtagtcaaattgcatggatggacgagtataaatcatgataccacgccgagaatcaggattttgaccaagttcagctaaacacatatcatactgggcatagttatcttctgaccaaatagcccaaccataattcgagttaatttcgcctttagaagatgctacctgctgccaaatctttggtgtttcacctggaatatctttaacaaacaaactcttagatttataccattcaagttcacgctgaatgtattcatcattaagagcgccaaaaataaacggttcatctgctacaaatgatgcgccaataatttcaatagttttaacaccagttttatcaactacgaaatctttttcttttaatgcaagccccaaatgaagacggatttcttcaactgtcatagagtcactaatcatttaaacctcaattgatacattcatatttaacttgtaacagtaataaactccaacctaaaataatagttggaatcataagaggaaccgttacactatagtatatacttattataatcatcaagattaaaagcaacactgctataattttgcttttcattccttctctctgatgataattacctgatttggttgtgcagactttttagtttcacccgcaattgaccaaataaatgtaataaaccaaccaataattgaccagttaaacagtaaagatgtgaaaaagattcctactgtcgattttgacccacgcatcaaagcaataaaccatggaagcatgtatataataatagccaacacgcctgaaactaaaaccataaaaattgaacctgctactaaagtttccatgttttcctcacttagtcaaattttttacgcatgaattataagaattcactacatactccatcggagcatttttaccagtacgccattggtaattattagcccaattagcccaaatttcggcgcagtagttttcaattttttcttcgtgtgtaattacaccagaattacgatatgcttgagcagattcatctggacgaatagcttcgtcaaaattcgcctgcatttgttcgactgtttgctttggagcttctttataacacttgacattaggattataaaatttgcttgaacagtttacaatttttcctacatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacagtgctagattcaatcacaggttgagtatcattttcaacactaacaaatggaactgctgctaatgcaactaaacaaactgctaagcatcccataacaattttcattttattctccaaatccgtatcagtagttgatagttgtatagtaccatggaagaacattcttgtaaacagttttgtgaaaattttttagggaattctaaatgtccagaatcatctgtttttcataagtatagatttatattacttgtatgaaaaagggacccggaggtccctagatttattctatcagccaaacaggaagtctaacgaagctttttcttcatagtccataccggccgattcacacatgcccgcaagcggtttaacaaacgatttttggaacaaagttgagtagtcaatccaagacagtacgtcagaacgaatttcttttggaagttctgtacccgacggccaagcaatgcatttgtcaccaaatggatttccttcacgcaatggaagaaccattactttatttccatccaaaattggagctacacctaaaccgctaacagctcgacgataagttagcacaccacgaatatggaacggacatttaaatcctggccaacctttatcatcatatttcgctatatcgttcgcagtttttacttcagcaataactttatagtcaagttgacgatattctttctcgaagttcttgtaatattcttggacagactcttcaccttcctgaagaatacgacgaatactttcttcgagagcttcttggaccgctttaggcgttgaactctgctgagtttccatacccatgatttttagatgtggttcagcaaaacgcttatcttccatatcataaacgttcagagcataacgctttttcgctttccaaaatccaccaacgccctttgaaccaagtggagggcaagaaatagcttcacggtccatatgcatcagatgctcgcggttattcatataatcacataactcacgatatgcaacatcaatcataggttccatctttttcttaccgaactgattcatgaattcaactaaatcgttctgctctttgaatcggtcaagaccaactttttcaataactttatctacacaaacatataccgaatcagtatcacctgctgcgatgaaatcttcgccattggttccgcatactttattcagatattcattaattttacgagcaatccactgaataccaacttggccgaaaattgtgatagcagtagcatttcgcaaatcatagtaacggaaatgaatattaccaagagcaccataaagactgttaataagaattttacggttcagctgatttgtattagcaagtgtagccgctttttcacattcctcaatcagactattgagaacagattcagtataattcgatagttcatttaagaaatcatcactgaacttaacatatcgttcaacttcaggtttagttgaacaagaccctgcgcctttcataataatctttttaatagcttcggcattcatttcttcagcgaacattttctttttccaatctttacgctggaaaaatactttagcgatttcccttggaatgataccttcttgatgcttatcatacatccatccattcggagaacaagaatattcatcactcggtttaggagctgttcctgcgatatattcatgaattggatgaactttaaactgaccacgaatagtctcaggactaatgttaacctgacgaataatgctaggatacagagacgtcaagtcaaaactcataatatatcgacgagcaattggtttaggttcaaatacaaatgcacctggaaaactttgtttaacgtgcgaaccttgttgaggaataaccttatgttcacctttcaatgagttaaaaataatagcatcccaggttttaataggactcattacaccagaaaaaggcattttagcgtaataagacatacttaaaactagatcgataaacccgcgaattttatcaattgcttgaactgattctacgtcaatgatgttataactaatatatcgttgatgattagtctcacgaagtttattaataggaccgtcgtatggtaatttgccctttttagtttcatgctgagcaactgattccaaagagaatgacggcaaattagtaaatgcgaatttcttatacaaatctaaataatcaagaatagatacgccatcaatagaataaatttctttgctgccgtacatattttgaattagtttagattttacccgaccgattggagagaagcgtttcatactgcgttcaccgagaaccattttaacgcgattcatgatatacggaacgtcaaatccctcaatattccaaccagtaaaaatagcaggtcgtttctgttcccaaagattgatatattccatgagcatatcgcgctcattatcgaatggcatataaattactcggtcaagaatttcttgaggaacttcatcaccaccttcacagtcaagcttagcagctaactttgcatcccattttgatactgaaccgtacattgaattcaaaaggtcgaaaacataaaaacgatcatcaattgaatcatagtgagtgatagcatcaatttcatattcagctttcattgggtcaggaaatttatcaccagtaacctcaatgtcacagttagctacacgaacaaattttcggtcataaacaatttccgaaccatatatatcactgatataagcgagtttaaaatcgttcataccgagagcttcgagaccgatgtcttccattcgtttcatccaatctcgagcatctttcattgatggaaatttttgaggagcacaatttttaccatagatgtctttgtattttgactcttccttacaatgcctaaacatagtcggaagatattctacttcacgagtacgttcctttccgttttcatcaatataacgttcaacaatgttatttccgactgtttcaatagagatataaaattctttcatagatattccttagtttatagcccgagttattaggctcttgatatattatactccaattaaggggccgaagccccttgcttaattaccaatcgtatatttaggaacgagtttccattcatgtttttgtttaaaagaaataactcggaagttattagttaaatctttcataaaagttctttgaccaggaacgatttcaatcagtccccaatcttctaatagccatgcaatcgaatcacgacgaacttcatcttcttctgtcatttcaacttggcgaccatccatacgaagcatttctttaaaatgaacgatataatatagtccttttttctgaagaatatgacaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaaacctttaagttcttttaatactaaaggtagttttccatttttagtaagaattgatttatagttaattgcatcatttgtattaacttgataccgtttagcaagtaacttaataatcaatacttcggtggaatcttcaaccagttttgcccatttaccatatcttttaccacgaggaactgcagccattagataattaaaatgagcttcatcacttaatccagaaccgattaaattcattgcatatacagctggcatgcattctggaaattgtgataatgcattttcaaccatgaattttgaataatctttttgagcaatagagcatttagttttattattaatagctccaattatttcaaaaaattcattttcagctttttctttaaaagaatcagcagcggattggacagctgtccaatcttttgaataccaagcaacttgatgctcgtttaattgaatatcatcttcaaataagctcatatcacttccactgcatttcgcatgctaattgaatgaaaagataagctaaatgcaattcagtattagctgcaataccatgatactgattattttcgcctacaatttcgtacatacgaataatactctgcggagttacacgtgaatagatttcttcggcaagtttaccaacgaaccacgaataatcagctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttacagatttcagtcaatcgacgaatcatctgcttcatcatttcaattttatcttcatcggtcggttgaccgaacgtaataactcggcagcgtgactgaagtggtttaataataccatcaatattgttagcagtaataataatactacagtttgaactataagcttccataaaggaacgaagatgtcgctgagattctgctaaacctgaacggtcaaattcatcaataacgattactttttgacgaccatcaaatgaagcggcgctggcaaaattagtcaaaggaccacgaacgaaatcaattttacaatctgaaccattcacaaacatcatatcagcatttacatcatgacacaatgcttttgctacagttgttttacctgttcctggagaaggagaatgaagaataatatgtggaatcttacctttacttgtaatagatttaaaggtttctttatcaaaggcgggaagaatacattcatcgatagtagatggacgatatttctgttcaagaatgtgttctttttcatttacggtaatcataatttcctcattcaagttttagtgtaaattataaagggccgaagccctctattaaaaatcatgggtagaatcagcttcaagagctactacataattcgcatgttcaccttcaaatttagcagcgccttgtttaccttttgcccaaagcagaagtttataatttcctggttgcattttcatatttgccatattgataatgaaattaaatgtgttttcaccatcataatcaccaagagtcaaagaatatttaacacgggtcagagcagaatcttctactttattaaaaccgttaattacgattttaccttcttttactgtgatagcaattgtatcaatctgcagaccgcgagatacacgcaacaactgttgaaggtcttcagctttaatttcggtaacaacagatgctaccgggaatggaattggtttattaggagcaactactgtactcggatcggctgctggccaaaaaattgttgaacgggcatcagcaattttaatatttccatcttctgactgggaaatttctgcatcatcattaactagagacagaataccgagaaaaccgttcaaatcgtaaattgctacatcaaaatcaatagtgtcagaaatatttgcttccgcgtaagttgtaccattaactgcgcgagtcataataaattgaccggatttaagcataataccagagttaatagtagcgaaatttttaagcagagcagtagtatctttagacagtttcatgtaatttccttcaattcaaatgagatttaattttataactaatttaataaagcaattaacgattaaaatcagccgcaattgtttccgcaacaatttgagcagcaacaattagacgttcatctgcattaccgcaataatcatcttcaagacgttcaccacatgaagtcataataaatttagcaccggcgtttagggattctgtagtatgtttgcgcattagttcaatccatttattacttacttcacgatcgatagcttcataatacgcatgacgagcaggtgcagatttaattttgttctgaataacttccattgcgttatcagaaagagacaaaacccatgctcgacgaattttattttggttttgtggatttgattcagaacgcacgtgttttggctgaatatcttttacatcaacagtataattcacagtaattttagtcataatacacctttagtcataataatcagtaacagtccaagcttcatttctattggacattatttttatatattctgctttaaatgcattcctaagcatagattcagtaactatatgctcttcattagaaaaattatttctcagaatatatcgttttatttcaggaatagttaatagatgctgtccggttgaatattccatgtttttcctccatagagattatactctaataaattaaagcataatctcttataaattaaaccattacagtaaatcgaccaactttcttcatttgaagatgctgaccgtattcttgcgggtcatggtctttatgcgaaattataaaaacattagtgtttttcattgaatttataatattagctacacctttaataccttcggcatcaaatgacccatcaaacacttcatcgagtattaatgtactaatactaacaccagatacaatagaagcaatatcacgccaagtaaataaaagagcaatatcaattcgcgctttttcaccttcactaaatgaagcataactaaaatcttcgcgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcagtgctatttcatcagcatggtcaataaactcagaagatgctttttctatagccgctttaacctttttagctttatctactgctgcgatcagagattgctttttattgcgaatatcatttgccaacgactgttgggttttaatattatctcggtattcatcaacaagaacttttaaattatcacggtgtgttgaaagctgttcaaacgaatgcgtacattcagaaactttatctttaattttagaaacaactttatcaccggaacttaattgtgacaaacaggttggacataatccaccttcgtgatacatattaatgactttattatacgagtcaatttttgatttaattaaaactgcttcttgaccgattttattaaatgcatcagtcgggtcttcatctaaaacaatattaactaatctttcattagcttcttctatttcagattttagcgttctagcttcttttgccaaatcatcatacatattttgcagacgagtaaggttgtcacccgttaattttttctggcgttcaacgttatcattatatattttaatttgttggataatactatcttttttaacatcaagcacttggttctgcgaatttaattcacgtattagtgctttattaagcttatccatttcagctaatgttcctacctcaagcaggtcttccacaagctttcttcgtgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccgttaacggtgatttcgaaaacgtttggtttttgtcctcttttgatatagtattttttctcatcatattccatccacagttcaactaaaagttctttcttatttgtgctgtttattaattgacctttctttacatcacgaaatggcttgccaaaaagcccaaatgtgatggcttctagcatagtagacttaccaccgccatttcgtccagtaataagagttttttgaaccttatctaattgaatgtcaatcccattttgaccaactgacattatatttttatattttactctattaagtttaaaattcttcacaaaagattccttttaatgtatcttttagaccattctatcatatcatcataatctaaaaagtattcatcaaattcagccatgcaaacaacgccttgtgctgtttttgatgtaatataaattattccaacatatctagaatcttcttcggtataatcaatgtttgctatgaattcatcattaatgtcaaatgtcgaaaacttcacagtatgcatccttaatacaagatacggccatatctcgtaatgatttaggtgtgtcattatctaaaatgttgaagttaaaggatacagcccagtcagtgcagaccgtaacctttttaatacaattatcttcaacctctagcggttcaaaccaatattcaataatttctttatgcccaatatcatcttttacttcgcattcaaaatgctgactcatcataacatttttaaattcatcaaaagtcattgtgttgcctctacatatagctgatttgcatattgaataagtgcttcacggtcagaatcggtgatgtctggaattgcattaatgtattcttccatcaacgtctgaagagattgaacttcaacctcttcgctgtcatctgactcgacagagttatcaatctttgacacaactcgtaatgaatgcacaactttctctagttcagattcgaacttcgtcagatttttgtctacttcagttactataacacgtactgatagatttgtaaaatctttatagtcaatttttcctttaaatggataatgaattctacgatgccaggtagtattatttggaataaattccattcgttctgtttctgtatcaaacatccagaacccacgagggtcattctcgtcacctgctgttagtgtccatggtgtcccaatatatctgacgttagcagcctcagaaatagtatggaagtgaccagaccacacttctttataagtcttaaggaaatcaggttcaagaccatgagatttcattcctttataaaaataaaatccattcagttcccagtgaccaacacaaaaagaagcagatgaagttttgatatgctcaagaatttcaccagtattttcttcacacatccaaggaattaaatcaattaaacatccgtcaaaatctactgtagtaggcttatcatatactttaacattaggatatttagccaaaagctcagtagaggcatttggatgcattacatttttatagtggagatcgtgatttcctacaatagtatgtaatgtgattccagcaccatcaagcatttgaactatttcacgggcaaactccatagttttatgcgtgattgcttttcgcacatcaaaaatatcaccatattgaatccatacagtaattccatttttcttagaatattctatcgcttgtttaattccatcaatttgaataccgcgaatccactcatcatcagctttaacgcctaaatgccaatcacctaaatttaaaattttcatatatcaagaaccgtcattgaaatgcaaaataaaattattgaaataaacccatctggtgtgctaaagaaaccaatccagcatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcatatgctttttctcgctcacggtcataaagagctcggtcagatgacagttctttaatacgttcaaacgttgattccatatcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgcagatattttttatccaacttactcaactgataaccaaatccggatttactcatgcgttcaagcatttcgctatttacataacggtcaagaatttgcgttggcaaattaggagcaattttaatttggtctacttgatgaagacgataatactcgtatggaattcctttttctttaataggaatgaacgctggagaacgttccagaccttccataatagtacttagtcctgcaggtttaagatgtttttcatgaaaatcaaacatctgataaaaacctttccatgtagtcgtacgaccaatccaacggttgatattcatgttaatttcagaaacatctttccagtaggttgaccgaaccttcgcaatatccataggaggctgaaagttatatactgtcggtgcttcttcaatatcatcaaacagagaaacagtttctggataccattctttcatcagaactttattaaaatcaccattatcagaatggctaaaaataacatcagctcgacgaacagtttcttctaatcccaaatttcggcgtaaagaaagagaagaatggtcatgctgataaactacaacacgaaccgaaggtttaatgttatcaataatttttttatagttattaattgtgtcttcttcgactgaagtagcaggaactgaattgataattagaatatcacaatcatttaccagcttaagcgttttatcgtattcttttgccaataaaaccggaattgaaaatgatttataatcatgtgcacagttacgagtaaatgatttatctttagcataaaccaaagttacttcatgaccatttttaataaaccaatcacgctgctcaagagaaaatttagttacaccacaaccttcaagacctcgagccataaaaatacatactttcatttaatatcctctttgttttggtttattttaccaaaaatttataaagcaatataggagccgaagctcctatccacataatacgccatacagaggctcgttagaacttttaaattttatgcgcttatattttatagttccttctgctttagctttatcatgagactctttaaagcgtctcatcatttcctctttagaggaacgaattttattataatctatttcagaagtctgggtgttcatctttcacagttgccaccattttttgacttgataagaatcaacccacactttcatattagggtctgctcttacaataggaggattaacttctttaattgaactatcatggtattctttttcagaaattttcacacaaagatgaccattcagagattcagtaaatcctgcattaattttaagacgcttgaattttacgtgtgtaagcatcaatcatatcctcaatctgcgatctagtagtcttccaaagaatactaatgagttcatcgttatatggctgttttagaatatcccgacttttcttgatagcatattcgtattgagcaaaattattattttcagctgcgatctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgataccgatagtttaattctacaccattagatttaaaagcggtatcatacggattttctgggtcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacgactgtcatagacattgtgaacgaagtaactatatttctttgcaacttccttacgttcttttttaatacgttggacgaatgcattaaaacaagcttgagttatatacgcatgtgggtttttatatttcgtttcatcaaaattgtgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaagcagtatgcttggaacactttctccatcatctttttaaattcatgaatatctatataatgactagttaaatcagcatgatataaaaagtctaaaaacttttcatgtgtgctaacatattcactttcatttaattcagaaacatgactttcccaatatccaacaccagtcttatttgggaaaaatgaaattttcatgtattggtcaacatagaaaatgccataattttcaatagtaatagaaatattaataaatttcatacattcatcaacttagccgcttcaagagctgcatctagtgaatcaaattggtcaacatattcaatcaattcgccgtaattggcatataaccaccattggctaaattcatactcaaggatgaatccgtttccttcaatttgagttaaaccaatgccatttgtatttacttcatatccagcaagacgcaaatcgttaataagagcttcgttcataattataccttagtaattttcaggtctgcaaattttttcttgcgttgatttttcatgcgacgaatagttttatcggaaatttcatgcttttgataagctttagattctacaccaaaagctttaacatcaaattctgacaagatatattgaaccaacaattcacggacagtattgcgtccaatcttctgatcattctgtttcatcatctgatgaagctctttttcccatttatccaaaatttgaggagttacaatatcgcctttttctagcaaagaaactactttatcatatgcgtaagaattgatggcgtttttaatttgaatagtcatacattatcctcaattacgttaaaattttattatccaaaaaagggccgaagcccttagctaaactttttggcacccttccagccttcgtacatcattgcgactgacaatgacaaagctccttcacatgctgcatacttattattccagaaccaatttagaaaaacttcatcctcaataccattgtgtttcatgttctggaaaaatttggcgcgttcttcagcaattcgctgcgataatttagattcaggattcatttaaatttcccaattaccattttcatcaataaatttaatccagtcatttactgaccacttagttgtatcgccttttggagtagcatttaaagtatatagcccttgcttaaaaagcattcgtttgatattcatattttcctcagctgtaacgataacactcgtttgatttgcgtttagcaactcgttgagaagtattataatcaaaatcatcgtcaatgtaaactgattttttcaactttcttacttcaccacgtaattgacgattcaattcattcttaacctctgaatcaacacctcgcatacgtcgccatttatctgagcgaaaaatgttttcaaccatatctttatgacttacaccatcaggagctttacgctttccgaaatagtcataatcacgcacttttaagtctttacgacgatacgttttacccatggagtttaatttccttagcaactgaactaaatgcagcacgatcgcaaatcatgcgtttatgtaacttgagtataatatagcaaacttcaaaactatttacatgagtaacacgaacagcattaccattaatgagataatactgtccctttttaatttctttatcaaccataaccatatcaattcctcaaaggcaattcatatgttaataataccacagtttgagctcgttgtaaacaactttgtgaaaattattttagggaatgataagaagggaacgatagcttagaatggtaatatacagaatgtgagaaagaaggacccagagggcccgtcttagtcttctatgatatctctatcatatccaagtgaaatgagagtttctttgaaatgtttaatgttcttttgtctagaatcattaatgaaaatgactggataacgaatgttaagagatgtgaatccggcgcgtttagcaagagatacaatcagtggacgatcatactcaatcttaccattatttgtaagaactttatagaaagtaaaaggagcattgagctcctttagaagttttgtaactgattgacatccaggacaacgacctacttcttcggggatgccatagatttcaatcttattctttaagttcgagttttgttccacgagaaataattccttgataagcccagtatggcgggttaacagaatcctcaccagagttttcttcaggaaaataaacctggataacgaagccggattcatcaaaggtgaaataagtagtaggcagttcacctaacaaatcggcacgagcgttgatttcttcgaggtcttgttcacgtccagcccagaagcttgggttcagactacattcatagaaataatagtcattaccgaacatatcaaaaccattccaactctctactacataccgctcaaaactaatcataattaagcctttttatcaagaacagcattcagcttgttagtaattttatccagacgctcattaaactcactagaagataagcccttttctggagaaattaaactaatcacgaaaaatatagcaataaaaggaataaggaaaatagctccaactgccataaacagaaagaatgttacagttgtaagaaaatcagctaaacctttacgaaatttatacatattttacccttaattaattaaccaagcattgataagcactaaactatattgggaataaaattctggaccaaaatgaaaaatcatatcatttatagtatccataatgtaattcagtttaatcatgtttccacaccccatcggtatttgaccaaagtcgctgattatctgatcctcgccacagctttttagtcggaagatttttctcatacttcccatcaataataacatcaacatatttaagcatttctagctgtttaatatcttcaaacttatatcctgtccacaaccaaatgcttttattgggataaagatttttaatagtttgaaccacagagtgaatcacgtctctgttatcaggatagagagggtcacctccggttatagtcaatccttctatataatcattattcaaacattcaattaattgttctagtgtttcaccagtgaatggaacaccatttctagcattccatgttgatttattataacacccttcacatttatgcaaacaacctgtaacgaaaagaacggtcctgcagccaggaccattaacaaaatcgcaaggataaaatctatcataattcattggtgcttaaccctatgcatgatttctttatttttgccgagattaaatccgcgttcgttcggatttcccaaataaccacatgttcttcttattgtgttcatctttttaggatcagtttctccacaaatagaacaaacaaatccgttttcagtaggagtcatttcatgggtacttccacatgtaaaacatttatctactggcatattaacaccaaaataatctaaatgttgtgcagcataatcccagacagcctcaagaccttttaggttatttttcatatcaggaagttcaacataagaaatgtgaccacctgtcgcaatgaaatgatatggcgcttcacgagaaatcttttcaaacggagtaatattttcttctactgaaacatggaaactattagtgtaccagcctttatcagtaacatcctttacacttccatatttctcagtatcaagtttacagaagcgatagcacaggttttcagcaggagtagaatacaagctaaaagcaaaaccagttctttcagtccactgcttaagacgagcattcattttagttaaaatttcttgtccaatatcacgaccgacaagaatattcaattcatgaataccaatgtatcctaaagacactgaacttctaccatttttaaataactcaattatgtcgtcatcaggtttaagacgaaccccgaatgcaccttcttggtaaagaataggagcaacagttgctttaactccttttaaggaactaattctacacatcaaagcttcaaaacataaatccattcgttcattgaacaattcaacaaatttctgttcactgaattgtgttccaatataagaatctaacgcgatacgaggaagattcagtgttacaacaccgagattattacgtccatcaagaatttcattaccagtcgaatctttccatacgctcaagaaactacggcaacccattggagaaacaggaatagatgagccggtgatagctttattgttcttagctgaaataatatcaggatacatccttttgcttgcacactctagagcaagcagcttaatatcatagttcgggtcgtctttataaagattaacaccttcttcaacgaacataacaagcttagggaaaataggagttatcccatcacgaccaagacctttaatacgatttttcagaattgctttctgaatcattcgttcagtccagtcagttcccgtaccaaatgtaattgttacaaaaggcgtttgtccgtttgaactaaagagagtatttacttcatattcataagcttggaatgcatcgtatacgtctttttctgttttagattgagcataattcaacgcatcagcgatttgccatttttctgcatcctcaatatgttttgcataggtgcgtttaacataaggagaaagtactttatctacattcgcaaaagtcgttccgccgtattggtgagaagcaacctgtgcagtaatttgtgccataattgcagtagcaacgccaattgatttaggagtttcaatctgtgcattaccaagcttaaatccgttctcaagcattccttttaaatctactaaacagcaattagtaaaaggcaatgatatactgtaatctaaatcatgaaaatgaattaatccaacattatgggcatttacaatatgacttggaagaatacgacaagcgatatgtttagaaacaataccggccattaaatctctttttgttggaaagacgcgagaatctttgttggcgttttctgtatttaattctttatctttatttgaaataaaatttaaaacatctttttctaaagacataattctaatttatccttttgaaattcttcgtctaaatatgggttccaacccattttaaaccttttgatgaaattatcaattctaaattttggtaagtttaaatccgcaaaaatagatgatttacttttaaaatctggacttaaataatcatataaaatttctgcgtattttaaccataatatacaagtaccagatttaattgctctcggagttttccaaggttttacaccatacatcggatttccacttcctttatgcctgatagaagatgaaattccaattttaattttagcttcctttgtatgcgaaaatccacgatgcggattttctttccagtattttttagaagcttctgatattttctttctggctaaattagtatgatgctttccataaaatccatgatttttgcctttattacgatttcttttaatcatggttattgattgcttttctctagtttctttagaaggagaaacaccgtacgttgtaaattgaccatcagcatatgctaaattaaaatactctttattccatacatctttttctatattcttttgaaattcagcttcaatgctagttatttgttcatctccgactaattgaaaatataatatttcaactttcggcgtttctttcaacagggctttttgaaattcggaagatgacgaagacgaataataaaatttaccatttttatcaataatattcgttccgtcaaaagtgcaattagttttacttccaatgtaataatatggcggggttttagcattaattctattaataaatgatagtttatatactacattcattttaaactctttctaagctgcttcttgaatgaagctattaattgtgttttggtgtcagattcattatattcaaatcctctttgaagcatctcagccatcatttcctcttttcctaaacgagaaaattcctttgatttatctccaacaaagttagggtgaatattattttgggtgtaatcggattttaaataagtaagtaaattttctaaccattcaagataatcaacaccttgtccctttaagccagaacgattaaatttatgcttcatttgaccttctgcggcattgcatagattacaaagcaatccacgtacctttcctgcttttggtccatttaattcatggtcatgatcaagatgattagcttgaacatcaggatttagttctcgttggcaaattaagcatttaccgttttgtgcattataaaatttttgtttttcttctttgtataatttgccagtcaataacataataaaacccttaccttaaatagataagggtatttattatttttaagtattgtaaaacattcgatgcaatcgtttatactgtcgaatcatctttttagtaggacgagaataggttcctacgcaagtggtcatatgagggtccgtagaatgtcctttaataaaaagtttccaaaccttaccgccatttaacttttcagtataaaccaattcggttttcattaaaatgtcctgtcagaaaaagaattttgagttttttcaagtattataaaacatttgatgcaatcgcttatattgccgaatcttttggtcagaaaaagaaatttgagtttcaagccattcaatgtactctgcggcagcttgcatcaggttaccttcatagccatcgttattttcttgtgcagctaatttagctaatgcgtatgaaatacgttcaccttgaaaatcggctttaggcttctgaacaacttgattagttcgctctacaacttcttcaatttcgccattttcgactgattcagtattccacaagcaccaatacgtaattggcttatcgtagatgttaataatctttccgtcggaaagttcaatttcaataattccagtgtcaggctctatatcatcttcacattcttttacaagttcacgaactttaaagacagtacctgcactaagttccggccagtaattacatagccctgtatcaacacgattaattctaaaccacttatctactgtaatcatgtcccatctccatatcaattaagtcatttatcgttggttcattatatactgtttcttcatcagtgtaaaccggttcttccggctctggctctacagtttcccatctagccgcccaccaaggtttaaccccgaagcttattaagttcttcataatcaatccaggattctaatcctgatggcaaatcagattcaatttcccaaagaagctcttcaattttctgaagacgatctagttcttcggctggaatagtaaccattgatggagctcgtgatacattaatatcgtaaatcatatttaccccaatttaaccatacaatcgccgtatttccacttagaaatagacttttcaccattagaataataaacttcgagtttagcacgattatttttaatttgaataaccttggctgtcatcaaagttccatacccataataaactgcaacttcatcacctacatataccgcgcttccgcggtaatcatgaatatagtcagttccttcgagcatcatttaaaatattctcgcagttggtcaaatccaccaatatgacttccatcaggagcaaatacctgaggcattgtcaagccgatttgagtatcacgacctagtttagtcagaagctcagcgattttctcatcatcaaaaacacctttttccggcataatgttgataaattcaaacggctgtttcttcacagtcaaaagacgttttgcattatcgcaatacacgcatttatgaatgttgctatcataaccatatactttaaacatattattccttaattcctagtacttgtttaaaagtctcgtcgtaatcaagactttggcccgtttgttctttatgtttgtatataatatcacttacttctgatagcatatttttatatgaacgagttaaagcagatttaagcacgctgtatctatcaggaaatttaccgtgttcattataataagctattgctaattcacggactgccttttcagcagcctccatatattctttacgcttggtcatttttaatccaaaatattattaggcattggttgaacactcacaagttctttaaagaactcagtagagtcaggcaatttaaccatttccggagcatgcttactgaatttatgtttacattgacggcatttatattcaagctctggtttacgccagttaatcaactgaacttgttcagtaccgcattcagggcaattaggaacgtttttagaagctctttcacgtcgttcaaccatagccataatagcatcccatgctggaggtttaaaatctaaatcgtcgcagccgtgaatctttccacgcatttccatatcatcttcctcaccagccataataattttaattaaactggaattacttgaagctgcaatgtcttctaataaacgctttttcatttcaatacctcaatagcattacgtaaaccatttgcttttgcattaagagcttttaacaatttggcgtgttctgcaatttgggcttcaacttcaatcaaacgggcattgagatattcacgttcttcactcagattatcaaccttttctactttaggctcttttacaactgtcttatatgtattagggttcttcagtttaattagaatgcgtgaactgtataacattgaaccattatcttcggtttcgtcatgcatttccactacgtccataatttttaacatcatgcggagtttataagacaacgaacgaatagttttgttgtgcttattaatttctttagctgtcatggtgccaagattacgtgagtaataataaggaacctggatattaattaatactgatgaaccacctggcttgtgtattacttcatcagcaataacccagtccttaacatgaactgtatttgtacggtcatcgcccgcggtaaatagtttgcgagcatgcttaaaaagcatattcacttggtcattgaattgacaagcaaatttatcagcaaatttagtttcaggaatggtagaaaaccaatcagccaaatgagtctttttaacatcattaacaatagtaaattcaaccaaatcggttatagatgtctcagatttaatgaagctcggcttcataaagtttttaatgttctcatgagctacagtagaagataacatacgagaacgtttaaaccattcaagcaaattgcctaacgaatgagaataagcgttttgagtatctttacagatatgattttcctgaccaacatattgaaggaaatcacgaagaatattattgattactgctctgtgcccgatctgataattacggtgtttagtaataagactgtcaaaataatcaatataatgtttacgagttttcatattcttctcacttggttaatggtttatactccgagccatccttggctttaaattacttaattaactgtaaagcttgttcaagacgatcaagacgattaacggattcttcccaaatctttttagcctgctcatattctttctgcgctttattagaaatttctagaacttctttataagctttttctagtgcaataacttctggacgaatttctactggttcaggcgaatcgtcaagacattccattagttcctcaagggtagtttcttctttaggagtattcacaatttcatcacatttttgttggtaaatttctttatcagtcggtgagtacgcacactttacttcacggagactaactacaattttatatccttcccaaccgcatatattcttaaaaggataagtatgaatattttctactgtttccatacaaagtaatgcggtctctaactgacgagttatatcgctagcaattgagaaaaatttattaatgttcttttgattagcttctggtgtaaaaaattcataattcacaaaaatagctgctttatttttatcaagctcatattcttttatgataatcatatcagaagcccaaggatggatttgacgataatcaccatagcataatttagaagctgattttagaatttgcttcttgaaaagtctaaaattactaatccaacgacgagtaaaaatattctcagggtcttctttattattaagatgataagaattaacatcaccgaaccaactgtatcctactacatctttagttcgtttaatttctttcccaaatttaccaagaatatcttgattaactaaatatgaaagaagacgagaacctttaaaagtttccttaatatcatctttatattcgcgactagaaattttatgaacttcatgaataaatttgcttgaagaaacaatacttgcatcaatattattgagccattgattgataatggaaataacactattctgactaaacacaggtttaactttatcatcaataacgctattgaatgatttgatatattcgttacgagtcatattaatctcctcagtagaaagtaagaacattataccacatccttgtggcaaagtaaactagtttagtgcatttagtgcattgttcagtttagaacgttgcttcgtaagatttttgactttttcttgagctttttctagcatcttttcagcttctaacacttcattagttgctttaacgagttcatcatctactgccttgatagacttctcaatcgcatccgcgtgccatttttcaacaggtttaagactcggattttcaacaggaagaaaattcactttattgaatttccatgtatctttattacctgaactatacatccaaaatttaggatcgtttgatgagtaattggataaatttaagatatcttgcacttcctgctttttctcttgcgggacttcgtcctttctcaaaaaatcgtatttaaatgaaacgatcatatcaagttcatacgttgttgtatgttcccaatttcgctcaaaatgaggtaaaatcttagactgaaccgcggcaactacatccatatacttaaatgcttctgtcaactgtgatttaaggcattcacaaattgaaagagaattttttgtattaggtttaaagctaattcgtgcagttctgttattttcttttaatggtcttacttccatctgaagagtataaccatcaaatttcagattctttaagttaatatcagaaccttttaatcgactagccgtcgacaaaatttgctttaattgtttacggaatagagcaataaatctccactcaatacgataatgatttggattaaaaaatcctgttgataaatcaaccttactctgaccaacgccttgaacaaatagaggatttttataatcaatagttttacagaaatcggtgagctgctcacgagccgtcatttgtgtaatataccccgctttactaaaatgacgtaaccattcactgctattcatatatttaaagtgaatatcacgattaactttatcagggtctaaattattttggcacaaaaatgtcataacatcacgagtatagctggcattacgaaccatatcttcaatttgagaacgagttttcatggtgtgttccttaagatttaagtaaatcgacaattttaattaacttttcacgctcagatttagctttactactcagtccagatagtctgaaaatttcatcatcatattgttgaatagaaatattcagctcttcaatctgtttattaaaataatcaatttgttcagaatgtttttcgttactacgaactggtacaggttttgtaggcaatttagttgaactggattcatccgggcgataaattaaaatacaacttgaaccaatagggcattttgcaccagatgaatattctaatgttccggcttcttttaaaacttcaaaagctaaacagagatgatgccccatattaacataatctgtagagtgagctctgatataataatcatcgccacgaatactaaatttaaagcatttaaggtcttctgtattattggtcttaaaaatcatttgtttatctagacctttagctaatcgagcgcctaatgctaataatcgtcgttgattttcccacaaatctgcgatcatttggtcaaatgataatttcggcattagtcgaccataaaggtcatatcctttattataattgcgaaggatttcactcgcattaatacgagacaacgctccaattttattaagggctttcatgatgcgattagataaacccattccagatccgtttgttcgttgcaaatgtttatctaatccaaacccaatatcaactttaaatttatctaaaatttcagcatgaacatctctgtcaataacattcaaatccaaagttgggttaaatctatgaaaaaatttatctggctctccacgacgaagtacagtccattcatttaattttttattaactaaagatttaattactgcattgacattattaattactactgacatatttttctcactcaattttcaattttactaaatacacagaatatgatggaaaagactatataagcaccgaatacagattgaactaataccattccaaagaaccaaacaatattatcaaacaatgtctgttttacgtcgaaaggacgtaaacttacagtaatattatcgcctttttctattgatgaatacatctctggtgaaatatattcactaaatctataaccgtctttgagttcatatacggcaataaacgataaactagacccctttccttgagttcctgtaagggtattaactacagtaacatcataatctttataatgcatataatcattaattgcataataaccatatgcaactactacacataaacaacatatcaataaattcaatcttttaattatcaactgtttcataataatctcaattaaaagggcttagaaccattataccatccttggtataaagcggttatgcgagtaccgtctttaaccgttcttcaaacttccgaagagtattttggcgttcagctctttgctttttgtaagtttcaatacgctctgaaatgagagtgtatcgttcatttactgattctttcataaaatcaggaatttcacgagaagctttaatctcgtcaaatttatcaataactgcttgctcttcagcaattaagttatcatacatcaaaatatctttcttgatgaactcaatatcttcttgagttacacgagataatttagatgctttatcctttttgtactgttcgttagtatcacgagaccagtgtaatgtacgttttttattcgtattcttgtaaatttctacaataccaatctcatcgataataacgatccaattccaacgagatttgtaaatttgtcctccgtcaaccgtgatttcacctccgattgagatgtcattaaagaacttgctttgtgcttcagatttaaatttaccatcgttgtaatttaccaggttgaaaatatctttagcgttcattttgtgttcctccgtagttgatagttgtatagtaccacagaggaacagtcttgtaaaccactaaaagaaacttctttcacaattttttccactgaaccatgcgcttaccgctttcttagtctcaggagcagtgttatccataaaccattcaaaggcagcctttttatgattctggagggcttctcgggctttaatctgctcacggtctattaacactaacatatgagcctttcttgtcaccatgggcttcttatgattttttgaatactcccagtcatttgtccatcgcattgtcgttgcgaacttaaatactgcttctttaattttagtttcgtaaatttcacgagcctttgagtataacatcattacctccattcaccagtttaattctagtcatctttttaatggcagtccatataatctatttctgaactgcctttttgtcatagaagtcctcttatgaatttatttcagaagagtaacctcagcgatttcttcccaaccgtttttgtcggtcataataaagtcagcaagataaagagcagtacgcagtgaaacattgcgtaaacgattaacattgactttcatccatgataatgctttataagtttcttcatcagaaagaccgcgtttttgcatcatgtcagttgaaagaataacatcttcaaccctgaccataatttcttcattagtgtgaacacccaaatctaaataaactgagcgggacactaatgcttgtaaatgtggagcaagtttagtaccacggtctaattcgcggtcaatgtcaacgtttgtgataaaaacaatcgttcctttaaattcaaactcacgctcaatgcctttttcttctaagtaagaagacgcagtgctccagcagactttacgggtctctccggtgtccagagcagctttcagaagattaagaatgtccatatcagagaaaacatccacatcatcaatcaaaaggacagaattctcttcacgattattccaaagctgttcataaagaccaataccagagattttaccattaatgcttttatattcaatgtatccaatatcatttgctttatttaaagctttatctaaagaatacgttttaccaatgcctgccgcaccagagataattaatgaacgaatgtttccgttaataataccattcgtcatcattcccataacattaaatcttttattaatgcgggttttcatatcttcatacgattctttaacttcttcaacttttacaccatcatatgaaatgtctgatttgtaaacccaaacaccgcgacgtttaccgtcaatttcaacaaaaactttaccatctccttgtgcatctactggagcattatctgggaaccattcgcctaagagctcaaaagttccagagatttctttaccgaagtagatacccttattgatagttacagttttcattttattctccaaatccgtatcagttgatagttgtatagtaccataaagctttatgcttgtaaacaattttgtgaaaaaatttttgaaataaaaaaaaagggagcccgaaggctccctatcatttataataacttcggtggttttcaagataaacctgttcgaggaaattattccaaaagctcatatctactgttttaggcataccattcttagaagcttcagtagatgctgcttctacttgatcgaccacatcttccaaaaactcttgaactgttttaaatggatgtttacccaacttcacgtcgagaataaatggagcatcttggagtggataaaccaagtcaccagttttgtaaatttccaatagttgaagtccaccacgacaagcatgactcagagctttccagtcaataccttcattggcttcggccttacgagcacgttcaccatattcagcatctaatttgttcagtgactgcttaagctcaataagagaaagcgttgtctgatatttacgacccaacactgtgtagaacgtttgtggacctgttttctcatgattatggaacacccattcacagaattcgttttctggaagacgatgcttaatatcttcaactttagtgcgacgctgcttaatagaaccatcttcttggtaatcaacccattgctcagggatttgattaactactttcaatacatcacgtaatgcagccaaacgagaacccttgacaccgtatttagaagcttgcttgcggacatatcctaaatatgatttcatgttagtcgtataaaaacgagaacggttgtcttgaataaacttccacacatcaggcaaatcagatttaaccactagttcaggtggagtgtgaagcatatccaacgctacagtttcaccatctgccgctaatttaaagaaatacttaagactgtatagttcatggtcaatatcatctttagtgtttttagatgatgtgttgttagtgtttttactcatgtgctctttgacatttccgataagaatatcgcgagcaggaggaacaaagatttctttaaaatctacatcagattctggggtagaagttccataaagatgactaccaaaatagcttttcattactgttttcatcattcagccttatattcaataacaggacatactttagctttacgcgcttttaaaaattcgacgataatagatttcttgggttgaataggaggtaaacctttatacgccctatcaatattttctacatgtaaagcataatcctttttccatttataatctttatatttttcatgcagttgtgcaggaataacaaatgaaccaataataagtaaaataagcaaaatggcaagtataaatgctgatggaataagagtccataaactaccaaaaataagccatttctgtatgatttctgcacagataatagttagacctgcgagtatagtacatccgaaaaaagaaacgaaaaatgtagggataacaatagaccaaaagtatgcacacagtgtcttaggtcgtttccattcgtcgttaaacagtttgaataatttatagtgccaagagttttcattaataatcataattatcctttcattgaaggtgtaacagttgttaaatacttaatcatagcttcagcttctgattttgataatgaaatttctccattgttttgacgaatagaaataaaatccggatgacggtcaccaccagcttttaaaacacacatataagtatcagtttcatcttcaatatctgaaatgattgaagcagttccacatgaatgtggtttttgataaatcaatacagcttttcttccaccgtttgactgttcataaacttttaacacatcaaacaaatcgcttcttttatcaatagctaagatgttgttttcatcttcaatattaaatccttcggatacttcataaagtgtcacccataaatcaccaatatcaataacagcgttcacttttccatgactttcaagagcattacaaattttcttaatttcatcataactcattttaataatatcatctccttgaataaggaagatgtcatttttaaattcaacacgaattaaaccacttccacttgaaataaacatatttcctcactttgaaatcatagttggaatgacagaatcgagataagtctttagcgcaatagcttcgtctttggtaaatgtgacaatatacgatcgaaaatcatcaatttgacgaatagttaagacatcaccatcttcatagcattttgatacgtttaaaacagtttcatcattctgattgcaagcgttagtaataatagcattgcaatttttgagccattttaaactatgttttctttcattagaataataaaaatatttaatcttatctataaaactatcccaatggataactgataaacacattgactcacttttaatattaaatcctgggcatgaagaataaaaatgaattttgtgctcatcattgatgcttactattttatcagtataaggatattcaatttgggttaaatgaatgatttcactaggcgtaaaatatagcatatcgtcttcttgtgtcaaacgatacatattatttactttttctatagctaattcaccaaaaagcggactaacttctaatactaatcgtttcatattgattctcttcgactcacccacaattacatactcctttgaataatatcaataatgttgttcaccagattataagtaaacattggataattatattgaatcatcacatacacaacaaacaaaactttcattctcttctccttggcagttgacaagattactatatcataatcttgtcaacttgtaaaccattaaatgacgttttcaataaaattctgaagctttgtgtgagcatcaaccatgattttcatttcttcctttgcgaaagctgtacctctttcccgagcagaatactcatagtcagaaactgcattagcatattcttcaattagcttcattaaaaacatctgcttttcagttttcattattccacctaatcatttcaagatattgaactaacttagctttggatttatccaaatcctttttagctgcttctataccgtcgtatgaatatccttcacaatgctcaactgctaattggtatgaatctatttcaatatcacgtgctaatttaataattttttcaaactgttcacgtgttagcataattaaactctcgtattatgatcgataatttcatcaagaaacatatctaacgcttctaaagcattatcaactttagcttcaaatttttcaatacctttatttgcaatgcctgccgaaaaccaagcaaagtcactaagttcctcatctgctttgcgaattaaagctaccaattctttaattttatctgcttgttcaattctagtcattattccaccacatatgaaagagagaatattgcacacgccatatgagttgcagcttcatcacacatatcataacgtttcttaagaagttctacaagttcttcactagtaacttcatccatgtcgacgaaaaaatcaccattaatgatgacgtagatatttccttcttgattgagtgcttcaattttcatgatgttctcctctttatccgatagttgtatagtaccacagctcaaacggaaagtaaaccggcaaaatgaaaaaagtctcccgaaggagactaatgttattcgagggaaagaagatacttactctggtaaaacattccagtaatatcatctatcgtgctttgaatggctggaggcatttctttataaatgctgttagattgatctagtatgcgatcaatcattttaattgtgtcggtaggaagtttactggcatctggaattgaaggcgtgtattttctaccagaataccccaaatattgctcaccaaatttatcaatcaaatctggcaactcggagaaaataaaatcgtatgctttgtgtctagcataacttttagtttcaaaatgtgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgctctatacattcaaaatcggaagagcacgggtcatttttataagtcgttcgcataaaactatagaactgttcagatgattctacgcttttattttcaaaaagcatataaacgtgtctaataccagattccataaatttatcaaaatgaggatcgacattcgcttcaattggtggagataaagcaaacgctaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagaacagtaagattgcgaagttgcttttcagttaattgtagcatatatacccctttagttagataaacctatttataacttttgcactaaccgagctttttagttaattcgttccaatgttttctacacaaagaaacataaatttcatcaccaatacagatttgattaccttctttaactggtgttccatcttccattaatcgagctgtcataatagcttttttaccacaatgacaaactgcctttagttcaataagtttatctgcaatcgccaaaagttctttagaaccttcaaataattttccagcgaaatcagtccttagcccataagccataacaggaacattatatgtatcaacaattcgacttaattgatgcacctgttcagtttttaaaaactgagcttcatctacaaatacacaatgaatatctttttgtgcttcagcccatttatagaactcaaaaatatccatatcatccgtaataatattcgcttcctgcttaattccaatgcgagaaacgacttcacagacagaatcgcgagtatcaatagcaggcttaagaactaatacacccattccgcgttctttataattatgtgcagcagtcaaaagagaagcagattttccagcattcattgctgcgtaagtaaaaattaaactcgccatatcaccttcttaaagcatattcacataagctattaattcgttttctttcttatcaaaccgatcagcaaattcttcttgctgttcgggagatagcgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattgacagcgagttcaattaaattatcaagctcacgtaacacttcatactgtaactcaaaactattcatttcggtttaccttctttaacgaaatctggataaggataaaatcccgaataaaatccttcacctttatgattgatgcatcctttattagaacaatagcaccaataatcgaaatcacaagccatttcatcgttgcataaagcaaaaacaactggccatttacacttttcacaatgggcatttttaagaatactagtttggctcataaccatgtaacctttaagcagtattcttctacatgctgtttacgacctttcttatcaataaaggtatattcaacgaatgttccaatgtagtctttatctacatcatgcggactattaattggacatttagtacggcaaatgcgttcccattgacgaataattactgccttattctttgggtcatatggatgtggataatgtatattcataataacggttcccaatcaacaatcacaatttctaatttagaggaatatgtatctaaaatcccctcaataatatcccagttccctttacctatgcctgcaccaatcctaggcatatagattgtaggtttaatcagtttattttcaccaaactcatttaattctaacatacaattcattaaagcggaatactcaaaatttggccctggttgaaattgagtataaaggttgaagcaatacgctttatgagtcctaaagtatttttcatagactgagtaagaaccgagtttagttacatcaccccattcagtctgtaatttatcagcttccaaaattttagggaaagctttggttaattgacccgctacgcctgaacccatagtatgaaaacaattgcatccatgcgcaatatttttaccttcagcgaaaagggcgacaatatcgcccttgatatattttacaatcatctagtactcaatcctcgattataagaatctaccaaacggtcaaccattgaatgacaagcggctttatctttctcctccgcaactgaacattctaaggtattccgctttttagcatatcgttttaataatgtatcgtttttgtatctgcttgatttatctctttctccgtctttatatgcatatattaatttctgcgcaaattcagcttggcatgctttatttttcccacaataatctgccgcagtgcgatttacatattctctaatttcagtatatgatgtatctgctaacgcagaaaatgaaattaatcctatacataaaaccaaaattttagtcatttactatttccaaaagtttattatttttaaggtaattagccttttctaggacttcagaagcatatttagaacctgctttaacattccatcccgaattataagatgatattgcttttcttatatcgcccttatgtatatttaaccaataagaaagttcaatgtacgcccaggaagctgaattggatcgtttattcaacattctttttatttcagcatcggtcatattataaccaagttccttaactcttgctcgcatagtaggcaaataattttggaacattccataagcgtgatgctttggtttagattttaaattaactccgccagagctttcttgccataaaatggctgccattatatggcctaatccgctcttgtggatgtttttgtgtgttttatattttccatccttagaaaattgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactgttgataattgccatcctgcattgaagtgacgggtttttgaacttctcattaggcttacaaaccgtaaatccaagccaaagatttccatctgtgatttctaaacgtccaggacgatattcaaccccatcaataaaatcctcgtcaatgtcaggacgcggaggcatactcaggaattcattaacttctaaaacatggtcttttattttatggaataattcaaaaacatatgtctcatcaatctcccgttgaattgcacgatcaagaagatgttgagaatattttagatgaaacgatgagactcctgctgcttttgatgcctcacgaatctcattgttaatttgacgaaactccgactcaaaatgacgacgaagcttatttcgacggataaaaacttctgtattgatagtcatgttgttctcctcttaactgatagaaaaattataccacagtcaagaggaaaagtaaacagttattctttaaatctaatcaatttattcatagactttgaaacttctgcacgaacctcatgtagatttttgagctgttcaagacgctgcgtatagtaagcaatttcatcttcttcgagacagtcctgtgaatcttctttaagataccgtgcatagtcctggaaagcgttacggactacttcctggaagtcatcaagactttgaattttcttaggagcagcagacacacgacgaggggcagtataatactcataaccaaaccctgcgcttaattgagccattagtatttttcctctggttggaacacagcacgacaagcccacatactggcttctttgagtttcgttttagcaatagctaactgatcgaggctttcagcataattcttcgcgagttcaaagtcttcgcaattatctagtgcttcccagaattcatcatataaagcatcaaagataagtcctaaacgaacttcagcgtctttaatagcatttactttaccgattttttcgtcggtatgtggcttataacctttaatatcttcaatcatatttgacttcctcaccagtacataaatcgtattcaactaaacgaataggttcatgaatgccatatccctgaacagaaatttctgtcgtaggataaattccactaatatcacccatattccacgcttcgttaaattgctgttcgcctgaattactaaaccactcggcgaaagcatttagcacatcttcagaaccttcaataattatctttgccattacaaactctcggtgaaggtacgagcgataacgtcgcgctgctgttccggagtcagagagttaaagcgaactgcataaccggatacacggatggtcagctgcggatatttttccggatgcttaactgcatcttccagagtttcacgacgcagaacgttaacgttcaggtgttgaccaccttcaattttaactgtaggctgtggctcaatttcaatttcacgggcatgcaaaccgtagaaaatttctgggtctacaaaagagtccactttaaaggttttagagacaataattcgtgcttgaataccatcttcaaaataaatagtacctttatgtgtgccttcaagaatttgatatgctttcatataacctcaattagaaaataattttatccaagattgttctttaattaaaaatggctcagaatcatatgccattaaactttgagtaattaatcctttaaatggtccatcaataaattccatggtaaaatatggaattttattcattaatcttgcattaggagcagtgcacaaaactctgcatcctttgaatacacctttttgtaatttgtattgcttgggataaaattcgctcaagacgttgttatttgccaaaatttcaaaatgattcaccaatttatttttaatagtttttggcgaaaaataaagatattcgaaaagttgcgtatctgtcatcattgcattccaattacgaaaaactgcggacgagtaataccgccaatgcagcatttactattgcagcagtgttgcacagtttcaatatgaatatcgtaaatcttatccatatcaggagatttgacaggctcatcaattatatacaaaattcgcgaaagcgataaacctctgaacttgcttcctttattaccaataaaactgcgtacagaatcagtaaataaacgaaaacgtatatcatcattagaataacgtgaaaattcctttttaatgttatttgcagaaattttagcgtaagctgaagtattagaaagaacaataactgttccgccatcatacaaccaattagcagcaaagttagtcacagcaattgatttaccagattgacgtccaccgtctagtcgaagtgtgcaatactgtttaagcaagtcttcaaatggcaggatatattcgtttttacaaatttcttctactctagcatcagaatggtgtgtaaaagcattcatcagggatagataaggaccagttaaaaatgttctcattttattctctctaaatttgggccattccatggcgcatgaattgtccatttctgtatttacccattaccgcacttgggctcgaccttattacaggttggtggaatccctcacagaatcatgaggtccaggttattcccatgttatttaaatgtaaatatttttgccgtaatacttataccagtgtggcttcattaaaattttttcatcgagtcgttgttgactcaacttaatagctgatttgcatggattataatcatttttccattctactggaatatcgctgatgtcaggaacttcagtatcttttatactgaacccgcgttttaagcattccgttataatgtccgattgacgctttcgcaaaaattctaacttatcgtaaaagaaagtaacatgaccagaacctaaaataaatttagaagatattttaaaatctttaacgcgcttaccgtttgccacatgcttacgaactataccaaaaacacgcggcaattcacggtattctgcgattaaatgttgatcagcaagttcagatactaaagtcaaattaatacgagtcattttatccctccaagtaactgtgaatatactatcacaattctaggagaaagtaaacaactttatagatttttatacgcgtcccaagtgccagttctaaacgttgcaatgactcgttttgcgcgattaggtgtttgattataccatctacttttagctaagttaactgctgcttcatcccagcgtttttgctggagcatgcgtaaagaattagtaaatcctgctacaccggtttcccccatttggaagaccatgttaatcaatgcacagcggcgaacagcatcaagagaatcataaactggttttaatttagcatttctcagaattccgcgaacagcagcatcaacatcctgattaaagagtttttcggcctcatcttttgtaattacaccattacaattacgcccaatagctttatctaattcagatttagcaacacttagtgatggacttttagtaagcaaatgaccgatgccaatagtgtaatagccttctgtgtctttatagattttgagtctaagaccttcatctatacgtaacatttcaaatatattcataatacctcctaagtatttatagaaggtatttataaattaaaagaggctgttcattattcggtaaagtgaaggacccatcacatattgccactgagtacgaggaataagagcaaaagcatccatctctggaatcataacgccatctttattttcaaaataagactcgcaatggcaatttctaaacatctcatgctctactggaatcgtataataaaataactgtaagtctttattactagaatatttaaatacacctaagtcttctagaaggtctggattataatcgataaaaccagtctcttctgagcattctctttttgcagcttccagtgcattcaaatcagaactttctacacgcccctttggaatatcccagcgatgtgcaatcattccaggtttacgagaaccggtaactcgtcccataaataaatctttatcttctgtcataaagataataccagctgataatgttttcattttaatttcctgcattcagtgataaaattatttaatttttgagcatatttcttttcatcaaaaatcttttgttgtctgcgtaaacgccatggcatttcaatgaacatacgccatattcctgataatactgctgctgtaaaaatattaacaagtatagttaaaagaacccaatctcctattctgtccattggattttttataaaaaagtaaaatacgaacgatgatataggaagactaatgatataccacagaagaaccttcttatctgtgaaccaatcagcattcgttaacttagcgcgaccgttttgaatacatacgaacttatcatctgttacagtaaatggcttagctgcttgatatcccattctaaactccctaatcaacaaatttttcatatcttcggaacaaccattccagtcaactctatcaactgaaatgccatcatccccatcatctaaatcataccagcgagtttttaaaatcatttaattttcctacaatcactcacaaactctttcattgactcattttcaatataagacatgtagctattatattcttttaattgtattttgtaatctttttttctttgccaatttattttaaaattatcataatgaaaatataaaatgataccaaagaatgaaaacaatgaaataattttagtataacacagctcactccaaacttctgttatatttactgtgccgtcgatgtttaaaataagacagtcaattaacaatccaaaaagactacttgcaagagctgcagccaacgccacagcaaaaattaaaaatgactcagaaaacgaatatttgactttatttagttttggcttttgcatcgtgattccttaacaaatttcataatttcatcaaattcatacgcagcaagtttaagctgatgttcctttttaatctttttacactgtgctttccaatcacgtacgcgtttacgataatgccttccttgataccagtatcctacccaatttacgggtactaataaaagtggaactattaatggaagaattagcattaacacaagtatttcgccagaatcaatatcagtcataacatctaaaacacctccaataatcaatagaattacaaatgatatgagtataacaggacctattaacacatcagtagaaattatctgacgctttaattcatacttcaacggtttacttggaaggtatagtgatggctttgacatattctctacattccttaacaaatttttctagtaataaatcactttcaaaattgggattttctacgaatttatcaaaaagatcatcaacaatagttaagatattctttttactaagaatacgcttattttcatattttgtttcagagtcaactataagagtaaagaaatatttctttccctgaaattttaccgtagtatcaatataaaataaatttgatttttgtaaattacgtttaaaccatgcatcacttaaactataaacgccaagataatcataatcgtcgtttaaataacaaaccgtccattcaggagaaatgaaatcagtaaattcaacatcaaaatcacacgtcaatgaatgaattgattcaatactgttaatgagtattccaggacgtattaaagactttttacctctagaaaatcttccggaaaggctttcatcagtttcatatgaagacccccaatagtaattacgtccttctgccatgcgtttaagagcatttagtaattggtctggaacatcaacctgtctttggaactcttcaaacattgaattgaaatcactttgcattttcattttcattcctatttactccaagtataaggggccgaagccccttatcattatttcagagaattaatgtattcctgaacatcggcagaggtagtttcaaccccagaaatattaccgttaaaggtttcaactcgagcaagggtatcttcaatatcaaccttagtcagtgctgcaatttcaactacatcatcagcagtactaattccaagggcatttgctgcacgagtttcacggatatattccaatttaaccgcaagttcttggcgtgcatcatccaattcaactactttcttagcgatttcaattcgcatttcagcataaccgtcagctttagtagtcagttgttcagctgttcgacgatatagtaaaccgagtttagcatgcattgttacatcttgaccttcggaaagaagcttgcgaatttcacgctcttttgattcggcttgcttattcttttcgacaataagttcacgaatacgcttttcttcattaatagatttaacggaagcagtttttagatctttaattttatcaagcagttttgctgctgcagcagtatactgttcttcaacagatagatttttagccatagcagaaccaagtttagtgcgaataaactcaacaattttcttcagtgtgttcatagtatttccttaggttgattaagatttaaaatccgtaaaagtagtattatactctatcatcaagttacaggctcataatatctcaatcatgagcctatgtaaacttatttcatattattaaaatattcttctgcgatttcgtcgttatcgtggtaaactttagaagacagtttaacataaccttcagcagtgaacatattaatcacaacctttacagtataccactgtccgtcttcattacccattactgcgtaagtttcaaacatcggatggtcaggaccgataactttaatatcattcactgtacgaccaaaatcttctgaaacgcatttcataaagaagttgaacagttcgccgtaattatccatttcattctccaagttgtttttctgtatcagtagttgatagttgtatagtaccatggaagaacagagatgtaaacagttttgtgaaaaaatttttagggaattctagggcagggatgggcaattaaaggataggataatatattataaagggtataaactaaatgatgcctagagaggtccagaaaggcctagataccaaaaagccctatcatttagatagggatttaaaattatttacctagtttacttattatagcttctgcagcagcttttagcttagatgcagtgttaatacgatttttaatttcagtatacgcatcgccaagaacatcaaggctatcagaataaacacttacactattgcgttcgctatttgaaatagaacctttagttttgcggtcaaaatcggtgtacacgtcttgaagatcgcgggctgccttctttgcatcatccaatgcatcaagagctttattcaaagcattaacgtattttttagtgtcgaacatattcttagaaattttaacaggtgcgcgttcaggagtagctaacacagatttaggaacctgagcgccagatgccaatttcttagaaattttgaaaaatgctttattgaatttattttcttgactcattgtaaaagaactattatcgatgttgtacatttcaatagctttagctttccacttaagaaaatcgccgcggtcttttgggtccaattggaagaatactttagtaagatctgcttcagatggtaattttgctgcttcggttaaaaattcggcataggttttcatttaaaatccttgaaataatttatcggttggttattaattatttattactttgttactatccgtaacagcgttatccgagtgattcaaactaaaaagccccaacctttcggtcggggctaagaatgtcatttgatttgtttagcagaccaaatgcggtctttaataattttttggatgtcttcaacatactcaagagagtgaacatgtggattatctttgaaactataagcacgggctaacttttggccttcggttttgattactaaaagctctttaaggatagcttcatatttggagataattcctttaacaatatttttctcttgtgtgactttaggatcttctttaggagcaggtttacctgaagcctttgcaaaagcagctccagtagcaactaaacttttccaagccatactaactgcattccctgtaaatccttcggctttcatatcacgagcaaattggaatcgtgattcatcggaagcatctttataggaatatttacccgcggcaatggcagcttttgcaacagcttgaatttcagtgctagatgcttcatttaacaccgcttcatttaaaaattgagtatatgatttcatcttatttcctgttttaattcggggttttaatatacttatttatactaaaaagccccaacctttcggtcggggctaagccttgcggcaaccttgtcggggttccacctgctaaggcaagtgtttgtacgaaacgccgggattcgaacccggttattaagtagttgacgctactcaatatttttaaaaggccatatctcgaccatatccgaacgttccgtcaaaaacgctactcggcttacggcaaagatatttcctcgaatcgataattcggtgcgccgtttctgctgtgatataaggggacattaacaaaacataaagatttattaataccagtccttaaacagggaacatcagtccgacgacttgccggtagcgacccggcttcttgtctggtcgaggcagtagggatcgaacctacgacccaggacttagaaggtccttgctcttccttctgagctatgcctcgtatttggcggacgtgataggattcgaacctataaccaatcgcttaacaggcgatcgctctgccattgagctacacatccaaattggtggggagtggtggagtcgaaccacccgagtcgcaatgacaatgaatttacagtccacaccgctacctctacgggataactccccaaattaatttggtggccctgggtggaattgaaccaccatctggcgattatgagtcgcttgcttgaaccttccagctacagggccttggtgctgattgacggaatcgaaccgccgaccttctcattacaagtgagttgctctacctactgagctaaatcagcaaaactggcggaggcgataggatttgaacctatgagtcgccggagcgactgccggttttcaagaccggtgcattaaaccactctgccacgcctccagtctccgtggcaggatttgaacctacgacattctgctcccaaagcagacgctctaccaaactgagctacacggagtaaattaaattggagcggataatgagaatcgaactcacatcatcagattggaagtctgaggtaataccattatacgatatccgcaaatttggtgcgagaagtgggactcgaacccacaaggaaatcattccgcagcattttaagtgctgtgcctttaccaatttggccattctcgcgctgggaataaaggactcgaacctttgcatcctggaatcaaaatccagtgccttaccaacttggctaattcccaattattaacaaaggctcttaagcaagaacccttgatgatagagggtattaatcagtgcgatatgagttaataataacaaataattcttaaagcatatttaccatttataataatacatatttacgatgcattcaagacccaaaggattcttgaaaatatcatattcaagaggacctttttctgtttcaataaagaaatcaaaatttactgtattaaatttacgttcttccttcactaatttaacttgagaagatgaacggtcaatgtaaaccttttcaacttcaaaacatgttaaaatgccataatcatcaatcaaagctttagccgcgtcttgatcatatttatatccattttcaatggatgatactttcgcataaagaatcattatcagccttcatcaacaatagtgtgagtattagcatttacgatttgccaccaatcaaagcgattagaatccatcggtttgttttcattttctttgataatgtcacggagttcatcttcagagaatgctttagcaattaaatcggtatacccaccacggggataataattatcacctgcaaacaaaaggaaatttaccttcccggaagcaacatatgcttccttaggatacttgtttcctgcgtggtcaaccacttcaatataacggtaaggaatatcggttctttcaacccattgccatgccgccgcaggggaatcgaaagcatctacacctaaacgattatcttcatctttagacggattattttcgtaatccgcatatacataatattcaacgttcattattcacctttagaaattttatccataacaatagcaattaaaccaattaaaaatgctactacaagtgaaaacacattttctgctgtagtcaataatccacatataaatccaacaaacattgaaaaactaaaagcggaagcagaaattgcaatagcaacatttcgaattaattcacaacgtttcattttattctcctcagtagtagatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgttttgatagggtaatagtatcacaactaaaaccctatgtaaacaactttgtgaaattattttaaatcttctaatcgtttcttcatcttagaaccatttttagcaatttctcctgcatcggagcataatgctaaaagtgctttaactttagtttggtctcctttaaaagatgaaggatcgaccgcagcagcaagttctttaatacgagagaaaagacgctcagcttcagctaaagccattccaagctttacttccataccgtgggaagattcagtgatagtagtttttgtagcaaactctttgaaagttttcatttttattttcctaattaattttgatgaggtaatagtatcactacctcatcagtatgtaaacaactttgtgaaattattttaaatcatctgcccaattgagtttaagaggctctttgtattcacggtcaagtacaaccggaatttgtacatcaccgctaaatgataagggcccaacattataagacaatgttatatgcggtgtgtaatcatcaaaatcgtgtgtagcacctaatgcccgcgcatacatgtgtcgacagcgcagatattcagaatctagcacaagtacaagagtcgatccatcttgtgttttccatacttctaaatgtccagaagaagctacttcaaaacttccactcgatggaacatatggaacatttactcttgaataacatatagtcgaatgaattttttctctaggaactggattaggaacacgtaaagagcgctggagttcttccagcgcgtcaagtgttaattctgaaaacttagctgctacataaagacccgttgaaaagtctttaaattccatcattcttcatctgcagattcagcagtaagattcttgacagcttcaacgatttcttcaactttaatagtatcgccagtgatacctactgcatgagcaatttcagccaaagttccttgcagaattttggattcttccatcagacgagccgcttggtcctgcgtatcaagaatacgagatttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattactgtagcacccatcgccctagccgcatccatttcatgatcttgacgggtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcaataatcttgttaaatgctacggaattaactgattcttgtccttcgtcatcaaaaacaaacacacctttaattgggcttttaccattaagatagcaaaatgcttgttccataatcgtgattacttctaatttagttagatttaaattagtctcacgatcatagtcaattccttcaaactctttacgagttaagcaaggatagtcggtatttgctgcaaatactccccatgcataagccaatgcatccttaataggaccagcaagttggtatttaactgcagaataattgctcatgataaaatcagcagtagtatcttttccactacgctttacaccgcttaaaaagattagtttcatatgtttctcctcaaatttagttaagattataacacatgaaactgaagcattaaacttccgctataatttttccatctttttctacttgaaaatacgtataaggaatcgttgctgtacatactaaagccgggtctgaatcttctgtgtagctaaattctacttcagataggtcagaaacccaaggcttataaaaatttattgacatcacgatttcagttttgctattatctaaaatgtaaagcgtaatgtattcaggacctgttttttgggcagtattttcacctgtaagatagttgctagttcctagcatccattcatacattcctatccatgacttaagttcttcatcaactataaatctcacgatgagtggatcgtactcaaatgtagcacctggacgttgtgctcggcccagtccaaacggcccagtcacggtatcagtaacaggtattctaattcctggaataggaactgactgagcatttaaagtaaaagcagatgtagtattactatgtggtattgatactacaaagttagttgtatttgcttggttaaaaatttgttgcagtgcttgcgacatatattcctcataatgctttataactgttggtggtataatgggtctaagtcccttccattcaattccatttagaacaaacaacagaaaagaatggaagataatagaattagatatttgaccagactttgtttgcagagaaacgttttccttttgaaacgaactgctgaagtggcatcaatacaacgttcgcccagtctttcggggcgatttcaacaaggctacccataatattaccaggtatatatgccttaatcatttggtctgcacccctaaatcctttcacttgactccaatcaatttttaatttcgttttattagtaatagtaggtgtatttgaatattgctttaaaagctcttctagaaattgctgacgagctttaggtggaatatagtgcaagtttaatccatacattaaattatgcttacctaaaccaaggtaaattattaaaggaaatttatcccagtaaggaagagtttccttgtgtttagcatcataagcaaaagcatatattcgtcccggctgcgggcgaacaaccttatgtccttttacttgcttaatagtttcagcaaaccactttctggttttattattaattgctgcaccttcattacgaattttatcacgcaatgtttgtctgaatgaatttatcataagcagttgtctttcttgcttattgagtttattcattggttttgattcaagcttttgaatcttttcagccgttttaattcctgaagcatattttgacattgctgaagtaaacgtagagtatttgattcctctttcttcagcaaattgctttcctgtcattccttttgctttggcctttttatattcaagacctatctgaatccatttcttttcgtttaatgattgcttaacctttggaacttggggagtgctttcattaattatttgaaaaatagccattatgcccccttaaagccaagagctcgtaatccatcttctgttaaaattctaaattttattccacgcttttcagctaaagattgtgctgctttccatttgtcggtgttaacagaccaggtataaatttcattcataaatcttttcttcgctgcggttgttagatgcgccggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatactttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgcttacgtacttattatatcaaaggttcaccacgcccggaagaattagcaaatactatatatggaaatccacagttgtattgggttttattgatgtgtaatgataattatgacccgtattatggatggattacttcacaagaagcagcttatcaagcatctatacaaaaatacaaaaatgtaggtggagaccaaatagtatatcatgtgaatgagaacggtgaaaaattttataatttaatatcatacgatgataatccatatgtttggtatgataaaggtgataaagctagaaaatatcctcaatatgaaggagcacttgctgctgttaatacgtatgaagatgctgttcttgaaaatgaaaaacttcgtcaaataaaaataatagcaaaatcagacattaattcatttatgaacgaccttatacgtataatggagaaatcttatggaaatgataagtaataaccttaattggtttgttggtgttgttgaagatagaatggacccattaaaattaggtcgtgttcgtgttcgtgtggttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaacggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggctgacatgcttcgccgtgatgaaggattaagactaaaagtttattgggatactgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcaaatgggtgttggcggtgtagctaaatttaacacaatgttaactgctatgttagccggagattgggaaaaagcatataaagccggtcgtgattcattgtggtatcaacaaacaaaaggccgtgcatcccgtgttaccatgattattcttacggggaatttggaatcatatggtgttgaagtgaaaaccccagctaggtctctatcagcaatggctgctactgtagctaaatcttctgacccggctgaccctcctattccaaatgactcgagaattttattcaaagaaccagtttcttcatataaaggtgaatatccttatgtgcatacaatggaaactgaaagcggacatattcaggaatttgatgatactcctgggcaagaacgatacagattagttcatccgactggaacttatgaagaagtatcaccgtcaggaagaagaacaagaaaaactgtcgataatttgtatgatataaccaacgctgatggtaattttttggtagccggtgataaaaagactaacgtcggtggatcagaaatttattacaacatggataatcgtcttcaccaaatagatggaagcaatacaatatttgtacgtggcgatgaaactaagacagttgaaggcaatggaactatcctagttaaaggtaatgttactattgtagttgaaggtaatgctgacattacagttaaaggagatgctaccactttagttgaaggaaatcaaactaacacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgcttatacggaacatatgaatctgtgtttggatttggaaatgacgcgttgaaatatcgtttaggcgatgaatttaaaactgctgcttcatgggaagaacttcctactgattctgatactcagttgtatttatggaaagctcctcaaaacctccagaagacattcacttacgaagtaacattaatatatgactaccaagaacaaagtgaatctggaggttctggcagtaattctaggtcatcttctgatactactgaaccgacagatcctcctgctccagtaagaaaaactctcgttaaaaattatactaaaactatagttggaaattggagtcgttgggctaataaattaagaagctatgtgtatgagaggtcatagatgtcaggattaagttatgataaatgtgttactgctggtcatgaagcatggcctccaacagttgtgaatgctacacaaagtaaagtattcactggaggaattgctgttctcgtagcaggtgatccaattacagaacatacagaaattaaaaagccatatgaaacacatggcggagtgacacaacccagaacttctaaggtatatgtcactggaaagaaagctgttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacgtttgctgaaataaaacaaaacctcattgaatggcttaatggccaaaatgaatttttggattatgattttgaaggctcaagattaaacgttctgtgcgaccttttggcttataatacgctgtacattcaacagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattactattcctcgcggaactcgctttttagcatatgcaaaagatacttctgttaatccatataacttcgtttctaccgaagacgttattgctattcgtgataaaaataaccaatattttccgcgtttaaaattggcccagggacgtatagtaagaactgaaatcatttatgataaattaacacctattatcatttatgataaaaatattgatagaaaccaggttaaattatacgttgatggagcagaatggattaactggacaagaaagtcaatggttcatgctggttctacatcgacaatttactacatgcgtgaaactattgatggaaatactgaattctattttggtgaaggtgaaatttctgttaatgcttctgaaggagctttgaccgctaattatatcggaggtcttaaacctactcagaactctacgattgttattgagtacatcagtactaatggtgctgacgcgaacggagcagtcggattttcatacgcagatacattaacaaatataactgtcatcaatattaatgaaaatccaaacgatgacccagattttgttggggcagatggcggcggtgatccagaagatattgagcgtatccgcgaattgggtactattaaacgcgaaacccagcaacgctgcgtaactgcgactgactatgatacattcgtttcagagagatttggttctattattcaagcagttcagactttcactgattctactaaacctggttatgcatttattgctgctaaacctaaatcaggtctgtatttaactactgtacagcgtgaagatattaaaaattatctcaaagactataatttagctcctattacgccatcaattatttctcctaattatctttttattaagactaatttaaaagtcacatatgctttaaataagctgcaagaatccgaacagtggctcgaaggtcaaataattgataaaattgatcgttattataccgaagacgtagaaatttttaattcatctttcgctaaatctaagatgttgacatatgtagatgatgcagatcattctatcattggctcatcagcgacaattcaaattgttcgtgaagtacaaaacttctataaaacgcctgaagcaggtattaaatacaataatcaaataaaagatcgttctatggaatctaatacgttttcatttaattctggacgaaaggttgtaaatcctgatactggtttagaagaagatgtattatatgacgttcgcatagtatcaacagaccgagattctaaaggaattggtaaagttattattggtccatttgcttctggcgatgttacagaaaatgaaaacattcagccatatacaggcaacgattttaacaaattagcaaattctgatggacgcgacaaatactatgttatcggtgaaataaattatccagctgatgtgatttattggaatatcgctaaaattaatttaacatctgaaaaatttgaagttcagaccatcgaattatattctgacccaaccgatgatgttatctttactcgcgacggttcactgattgtatttgaaaatgacttacgtccacaatacttaactatcgatttggagcctatatcacaatgacagtaaaagcaccttcagtcactagtctcagaatttccaagttatccgcaaatcaggtgcaagtacgctgggatgacgttggtgctaatttctactattttgtagaaatcgctgagacaaaaacgaactcgggggaaaatctcccgagtaatcaatacagatggattaacttaggatatactgcaaataacagcttcttttttgatgatgctgacccattgacatcatacattatcagagtagctacagctgcgcaagattttgagcagtctgattggatttataccgaagagtttgaaacttttgctacaaatgcttatacatttcaaaacatgattgaaatgcaattagccaataaattcattcaggaaaaatttactcttaataattctgattatgttaattttaacaatgacactataatggctgcattgatgaatgaatcatttcaattcagcccatcgtatgttgatgtttcatcaataagtaattttattattggtgaaaatgagtatcatgaaatacaaggttctattcagcaagtatgtaaggatattaaccgagtttatttgatggaatcagaaggaattctatatctttttgagcgctatcaacctgtagttaaagtatccaatgataaaggacaaacctggaaagccgtaaagctcttcaatgaccgtgtaggatatcctttatctaagacagtatattaccaatctgcgaacacaacatacgttctaggatacgacaagattttctatggccgtaaatcgactgacgttagatggtcagcagatgatgtcagattcagttcgcaggatataacatttgctaaacttggcgaccagttacatttaggatttgatgtagaaatctttggtacttatgcgactttaccagcgaatgtatatcgtatagctgaagccattacttgtacggatgattatatctatgttgttgccagagataaagttagatatataaaaacgagcaatgcacctatagattctgatccattatctccaacatattcggaaaggctatttgaatctgatacaatgactataactggaaatcctaaagcagtatgctataaaatggattctattggtgataaagtttttgctcttattatcggtgaagttgaaacattaaatgctaatcctagaacgtcaaaaataattgattctactgataaaggaatatatgttttaaatcatgacacaaaaacgtggaaaagagtttttggcaacactgaagaagaaagaagacgtattcaacctgggtatgcgaatatgtcaactgatggtaaattagtttctctatcttcgagtaattttaaatttttaaatgataacgttgttaatgaccctgaaactgtagcaaaatatcagttaatcggtgccgttaaatatgaatttcctcgtgaatggttagctgataagcattatcatatgatggcatttatagcagatgaaaagtctgattgggaaacttttacgcctcagccaatgaaatactacgcagaaccgttctttaattggtctaaaaaatctaacacacgctgttggataaacaactctaatagagctgtagtagtttatgctgatttaaaatacactaaagttatagaaaatattccggaaacatcaccagatagattagttcatgaatactgggatgatggtgattgtacgatagtaatgccaaatgttaaattcacgggatttaaaaaatatgcgtctgggatgcttttttataaatcttctggtgaaataatttcttattatgattttaactatcgtgtgagagatacagtagaaattatttggaagccgactggagtatttttaaaagcatttttacaaaaccaagagcatgagactccttggtcgccagaagaagagcatggattagctgaccctgatttaagaccattaattggcacaatgatgcctgattcttatttgttgcaggattcgaattttgaggcattttgtgaagcatatattcaatatctttctgacggatacggaactcagtataataatttacgaaatttaattcgtaatcagtatccacgagaagagcatgcgtgggaatatttgtggtcagagatatataaaagaaacatttatttaaatgctgacaaacgtgatgctgttgcaagattttttgaatcacgtagttatgatttttattctactaaaggaattgaagcatcatacaaatttctttttaaagttctttataatgaagaagttgaaattgaaattgaatctggggctggtactgaatatgacataatcgttcaatctgattctttgactgaagatttagtaggacaaacgatttatacagccacaggaagatgtaatgttacttatatagaaagaagttattctaatggtaaattgcaatggaccgtaactattcataatcttttgggaagattaattgctggtcaagaagttaaagcagaaagactccctagttttgaaggcgaaattattcgtggagttaaaggaaaggatttgcttcaaaacaatatagactatattaatagaagtagatcatactatgtaatgaaaattaaatccaatttaccttcttcccgctggaaatctgacgttattcgttttgttcatccagtaggatttggatttatagcaattacccttttaacgatgtttattaatgttggtttaactcttaaacacacagagacaataattaataaatataaaaactataaatgggattctggattgcctactgaatatgctgatagagtagctaaattaactccaaccggtgaaattgagcatgattcagtaacaggcgaagcaatttatgagcctggcccaatggctggtgtagaatatcctcttcctgatgactataatgctgaaaataataattcaatatttcaaggtcaattgccgtctgaacgacgtaaattaatgagtcccctatttgatgcttctggaacaacatttgcgcaatttagggatttagttaataaacgtctaaaagataatataggaaatccaagagaccctgaaaatccaacacaggttaaaatagatgaatgattcaagtgttatctatcgtgcgatagttacttcaaaatttagaacagaaaaaatgttgaatttttataattcaattggaagtggtccggataaaaacactatctttatcacatttggaagatcagaaccgtggtcatcaaatgaaaatgaggtgggctttgccccaccttatccaaccgattctgtattaggcgtaactgacatgtggacgcatatgatgggaacagtaaaggttcttccatcaatgcttgacgcagttattcctcgtcgagattggggagatactagatatccggatccatacacatttagaattaacgatattgtagtgtgtaactcagctccttacaacgctactgaatcaggcgcaggctggttagtatatcgttgtttagatgttcctgataccggaatgtgttcaatagcatctttaactaataaggatgaatgcctcaaattaggcggaaaatggactccttctgttaggtcaatgactcctcctgaaggtcgaggagatgcggaaggaacaatcgaacctggagacggatatgtttgggaatatctttttgagattccgcccgatgtatctataaatagatgcacaaatgaatatatcgtagttccttggcctgaggaattaaaagaagacccaactagatgggggtatgaagataatctcacttggcaacaagatgattttggattaatttaccgggttaaggcaaatactatccgttttaaagcatatttagattcagtttactttcctgatgctgcattgccaggaaataaaggatttagacaaatatcaataatcacaaatcctcttgaagctaaagctcatccaaatgacccaaatgttaaagctgaaaaggattattatgacccagaagatttaatgaggcattcgggcgaaatgatttatatggaaaataggccacctattatcatggcaatggatcagacagaagaaatcaatattctgtttacattttaaattaagggagcccatgggctccctttttctttataaatactataaactcataaggaaaccgctatgttcattcaagaaccaaagaaattgattgataccggcgaaattggtaacgcttctactggtgatatcttattcgacggtggtaataaaattaatagtgattttaacgcaatttataatgcgtttggcgatcagcgtaaaatggcagtagcaaatggcactggagcagatggtcaaattatccatgctactggatattatcaaaagcactctatcgcggagtacgcaactccagtgaaagttggcactagacatgatattgatacctctactgtaggtgttaaagttattattgaaagaggcgaactcggcgattgtgttgaattcattaactctaatggatcaatatcagttactaatcctttaacgattcaagctattgattcaattaaaggtgtttcaggtaatttagtagtaactagcccatatagtaaagtaactttacgctgtatttcatctgataattctacatcggtttggaattattctattgaaagtatgtttggacaaaaggaatcaccagctgaaggtacatggaatatttctacatccggatcagttgatattccactatttcatcgcactgaatacaatatggctaaattgctagttacgtgccaatcagtagatggaagaaaaattaaaacagcagaaataaatattcttgtggatactgttaattcagaagttatttcttctgagtatgctgtcatgagagttggaaatgaaacagaagaagacgagattgctaatattgcatttagtattaaaaccaactatgtaacggcgactataagttcttctaccgttggcatgagagcagcagttaaagttatcgctacgcagaaaatcggggtggctcaataatgaaacaaaatattaatatcggtaatgttgttgatgatggtaccggtgactacctgcgtaaaggtggtataaaaataaatgaaaactttgatgaactttattatgaacttggcgatggagatgttccatattcagccggtgcctggaaaacttataatgcttcatccggtcaaacattaaaagctaagtggggaaaatcatacgctattaatacctcttctggaagagtaactttacaacttcctaaaggaactgttaatgattataataaagtaattagagctagggatgtatttgcaacatggaacattaatccagttactttagtagctgcttctggggatacaattaaagggtcgtcatcgtcagttgaaattaatattcaatttagtgatttagagctcgtttattgcgctccaggacgttgggaatatgtcaaaaacaaacaaattgacaaaattattagttcagatattagtaatgtagcacgtaaagaatttttagtcgaagttcaaggacaaacagactttttagatgttttccgcggaactagctataatgttaataacatccgagtaaaacaccgtggtaatgaattatattacggcgatgtatttagtgaaaacagtgactttggctctcccggagaaaatgaaggagaattgattcctcttgatggatttaatattaggttaagacagccttgtaatattggtgacactgttcaaattgaaacatttatggatggtgtatcacaatggagaagttcatatacaagacgccaaataaaagtactggattcaaaactaacgtcaaaaacgtctttagaaggaagtatttacgttactgatttatcaacaatgaaatcaattccattttctgcatttggattaattcctggagaacctattaatcctaattctcttgaagttcgttttaatggaattttacaacaacaagctggaacagcaggatatcctctgtttttgtgtgaaggtgctaactcagatacgcaagcaggatgtatatctcttggtggtgaatggaaagaatcgaacacagattattctatagaatatgaagatggaaaacctgtcagtcttttatttgatagaaaatttgaatcaggtgatataatcgttataacatggtttaataatgatttaggaactcttttagaaaaagatgacattattgaattaactgatgaccgttatgttagtaaaggatcatctactgaagttactggggatgtagccttaacagattttgataaaatcggttggccaaatgttgaaaaagttgattcttatactagaacgtataattcaatatcatctattttcgacagcatttatcctgttggttcaatttatgaaaatgctataaacccaaataatccggtgacttatatgggatttggttcatggaaattatttggtaaaggacaagttttagtaggatggaatgatgatgttacggatccaaactttgctttaaacaataatgatttagattctagcggaaatccttcacatactgccggtggaacagttggtacaacatcagtaacgcttgaaaacgcaaatcttcctgcgactaaaactgatgaaagagttttaattgaagacgaaaatggatcagttattattggaggatgtcaatatgacccagacgaaactggtcctatatatacaaaatatcgtgaagactacgcaacaacaaactcttcacatactcctcctactaatattagtaatattcaaccgtctattactgtataccgttggataaggattgcataatgagtttacttaataataaagcgggagttatttcccgcttagcagattttcttggttttagaactaagaaaaatgatatttcggttatgaataatcagccagtaggcgctgtaacaatttcacaaatatcaaaaggtttttatgattcaaatgtagaatctgctatcaatgacgttagaaatatggcagagcaaccggttggagctgtattagttaatataagcggcgtatctcctactggcgtgcaacagaccgactattggtcatttgaaggaactgttactgatacttcagtcaaatcaggtgacccagttattgttaacatgtttggtattccagttaaagctactaatggaatgacttcaattgaatttactagtgccgttagaatagctctacaggaaatggttgtaaaatttattgcaattgattcatttgaagaccatcctaccataggaaataaaatacaagttaagtatttagataaccaagaacatatcttagaacaatactctgataaaggaattactttcaaacaggaaataatttctccttctaaacctgggtatggaacttggcaattattaggtgcgcaaactgttacgctagatagtcacacacaacctacagtattttattattttgagagagtagcatgagtaacaatacatatcagcacgtatcaaatgaatcaaaatatgttaaattcgatcctactggatcgaattttcctggcactgttacgacagtacagtctgcattatcaaaaataagtaatatcggcgtaaatggtattcctgatgcaactatggaagttaaaggaatagcaatgattgcgtcagaacaagaggttttagatggaactaataattctaaaatcgttacaccagctacattagcaacaagattattgtatccaaatgctactgaaactaaatatggtttaacgcgttattcaacaaatgaagaaacattaaaaggctcagataataattcatcaataacaccacaaaaactgaaataccacactgacgatgtgttcaaaaatagatattcgtctgagtcatcaaacggggttattaaaatatcatctacacctgcagctttggctggagttgatgatactactgcgatgactccgctaaaaacccaaaaacttgcaataaaattaatttcgcaaatagctccttcagaagacactgcaacagaatcggtgagaggagtagttcaattatctactgttgcacaaattcgtcaaggaactctccgcgaaggatatgcaatttccccgtatacctttatgaattctgttgcaacacatgaatataagggtgttatacgcctaggaacgcagactgaaattaataataatttgggtggtgttgcagtaacaggtgaaacactaaatggtcgaggagctaccggttctatgcgtggagtagttaaattaacgacgcaagccggtattgcccctgaaggtgatagctctggagcattagcatggaacgcagatgtaattaatactcgtggtggacaaactattaatggttctttaaatttagaccatcttacagcaaatggaatttggtcacgcggtggaatgtggaaaaatggcgatcaacctgttgccactgaaagatatgcgtccgaacgagttccggttggaactattatgatgtttgcgggtgattcagcacctccaggttggattatgtgtcatggtggaaccgtgtcaggtgaccaatttcctgattatagaaacgtagttggaacaagatttggtggcgattggaataatcctggcgttcctgatatgcgaggtcttttcgtcagaggagccggcacaggcggtcatattttaaatcaacgaggacaagatggttatggaaaggatagacttggcgtaggatgtgacggaatgcatgttggtggtgttcaagcacaacaaatgtcataccataaacacgccggtggttggggggaatataacagaagtgaaggcccatttggcgcgtctgtttatcaaggatatcttggaactagaaaatattccgactgggataatgcttcatacttcactaatgatggatttgaattaggcggaccgagagatgcccttggtacacttaatcgtgaaggattaattggttatgaaactagaccatggaatatatcattaaactatattattaaagttcattactaaggattacaaatgattgaattaaaagatttaccttttgttgatagcgttcctgacgaaggtcaggaacgtatttcatggattaaaaatggtgaagaaatactaggagctagcactaagtatggaaacgatggatcaatgaatagaccaattgtttccgtgtttaaaaacgtcgaggttcttgatgaaaatgtgggaattcttaaaactgccattgaaacatcgcagaaagatattaaaacaattcaaggagttttagatgtatcaggagatatagaagcactatcgcagatcagtgttaataaaaatgacatatcaaatttaaagacacttactaatgaacacactgatatattaactggaactaataatacagttgacaaaattattgctgatataggtccatttaatgatgaagaaaactctgtttatagaacaattagaaatgatttattgtggattaaacaagaactagggcaatattctggccaagacattaacggtcttcctgttgttggtaatgctagcacaggaatgaaacatagaataataacaaatagtacattattatcttcacaaggcattcgtttaagtgaattagaaaataaatttactgaatctgacgtaggatcattgacggttgaagttggtaaattacgcgatgaacttggtaataaaccagtagattttggaccaaatatttataatagattaaacactatagatgataaacaaactttaataaattctgatatagcagaaattaaatcttctattggatacccagaaaatgtttctataataacagaaattaataataacaaaagtagcattgaagctattaataatgaattaaatcagagtgaaggtgttaaacaacgcttaacatctattgaaacttctattggttcagatgatattccttctagtattaaaggaaaaattaaaaatcacacaacttctattgagtctttaaacggaattgttggtgaaaacacttcgtctggtttaagagcgaatgtttcgtggttaaatcaaattgttggaactgactctagcggaggacaaccgtctccttctggatctctattaaataaagtttcagtgcttgaaggagaagtttcagttttaaacaataatgttcaaaatatacaagttgaaataggaaataatagaacaggaattaaaggtcaagttattgaacttacttcacttataaatggaaataatcctgacggatcaactgttgaagaacgaggattaactaattctataaaaacgaatgaaactaatattgcggcagtcacgcaggaagtaaatacagctaaagacgatatatcctctttacagagcagcgttcaatctctacaagaagcgggttatattcctgaagctccaagagatgggcaagcatacgttcgtaaagacggcgaatgggtattgctttctacctttttatcaccagcataacatggggccgcaaggccccaaaggattttaaatgtcaggatataattctcagaatccaaaggaactcaaagatgtcattctaagacgtttaggggctccgattattaatgttgagttaacacccgatcaaatctacgattgcatccagcgtgccctagaattatatggtgaataccattttgatggactcaataaaggttttcatgttttttatgtaggggatgacgaagaaaagtacaaaaccggagtcttcgatttaagaggttccaacgtatttgcagtaactcgcattttacgcacaaatattgggtcaataacatctatggatggaaatgctacatatccgtggtttactgactttcttttaggaatggctggtattaatggcggaatgggaacgtcttgtaatagattttatggaccaaatgcctttggagctgatttaggatattttactcaacttaccagttatatgggaatgatgcaagatatgctctctcctattccagacttttggtttaattcagcaaatgaacaactcaaagtcatgggaaacttccaaaaatatgatttaattatcgtagaaagctggactaaatcatacattgatactaataaaatggttggaaatacagtaggatatggaacagtcggtccacaagatagctggtcattatctgaacgatataataatccagaccacaatttagtaggtcgtgttgttggtcaagacccaaatgttaagcaaggtgcttacaataatcgttgggtgaaagactacgctacagctttagctaaagaattgaatggtcaaattttagcacgccaccaaggtatgatgcttcctggcggtgttacaatcgatgggcagcgtttaatagaagaagctcgattagaaaaagaagcattacgtgaagaattatacttacttgaccctccatttggaattttggtaggttaatatggctacttacgataaaaatctttttgctaaattggaaaaccgcacgggttattctcagaccaatgaaactgaaatattaaatccttatgtaaatttcaatcattataaaaacagccaaatattagctgatgtattagtagctgaaagcattcaaatgcgaggtgtagaatgctattatgttccaagagagtatgtttcccctgatttggtattcggcgaagacttaaaaaataaatttactaaagcttggaaatttgctgcatatttaaattcatttgaaggatatgaaggagctaaatcgttctttggtaactttggtatgcaagtacaggatgaagttactttgtccattaatccaaacttgtttaaacaccaagtaaatggaaaagaaccgaaagaaggcgatttgatatattttcctatggataacagcttatttgaaattaactgggttgaaccatatgatccattttatcaattaggccaaaacgctattcgtaaaattacggcaggtaaattcatttattccggagaagaaattaatccagttctacagaaaaatgaaggaattaacattccagaatttagtgaattagaactaaatcctgttcgcaatcttaacggtattcatgatattaatattgatcagtatgctgaagtagatcaaattaattctgaagctaaagaatatgttgaaccttatgttgttgtcaataatagaggcaaatctttcgaatctagcccatttgataatgatttcatggattaataaatattataaactaattaaagcccagattaggagaaatcatgtttggttatttttataattcgtcttttagacgatatgctaccttgatgggcgatttgttttcaaatatccaaatcaaacgtcagttagaatctggtgataagtttatacgtgttcctattacatatgcgtcaaaggaacactttatgatgaaattgaataaatggacatcaataaattcacaagaagatgtagctaaagttgaaaccattctacctcgtataaatttacatttagttgattttagttataatgctccatttaaaacaaacattttaaatcagaatttactgcaaaaaggtgcaacttctgtagtatcgcagtataatccatctcctattaaaatgatttatgaattgagtatctttactcgctacgaagatgatatgtttcaaatagttgaacaaattcttccatattttcaacctcattttaatacaactatgtacgagcagtttggaaatgatattccatttaaaagggatatcaaaattgtattaatgtctgctgctatagacgaagctatagatggggataatttatctcgtcgtagaattgaatggtcattaacatttgaagtaaatggatggatgtatcctccagtagatgatgcagaaggattaattcgtactacttatacagattttcacgccaatacaagagatttgcctgatggcgaaggtgtttttgaatctgtcgatagcgaagttgttcctcgagatattaacccagaagactgggatggaacagtaaaacaaactttcactagtaatgtaaatagaccaacaccgccagaacctcctggcccaagaacatagaggttattatggaaggtcttgatataaacaaacttttagatatttctgatctccccggaattgacggggaggaaattaaagtatatgaacctctgcaattagtagaagttaaaagcaatccacaaaaccgcactcctgacttagaagatgattatggagtagttcgtcgaaatatgcattttcagcaacaaatgctaatggatgcagccaagatttttcttgagacagcaaagaatgctgattctcctcgtcacatggaagtatttgcaactcttatggggcaaatgactacgacgaacagagaaatactgaagcttcataaagatatgaaagacattacatctgagcaggttggcactaaaggtgctgttcctacaggtcaaatgaatattcagaatgcgacagtattcatgggttcaccaacagaattaatggacgaaattggtgatgcttacgaggctcaagaagctcgtgagaaggtgataaatggaacaaccgattaatgcattaaatgatttccatccgttaaatgaagctggaaaaattttaataaaacacccaagcttagcggaaagaaaagatgaagatggaattcattggataaaatctcagtgggatggaaaatggtatcctgaaaaattcagtgattaccttcgtctacataaaatagtaaaaattccaaacaactctgataagcctgaattatttcaaacttataaagataagaataataaaagatctcggtatatgggtcttcctaacttgaaacgagctaatattaaaacacaatggactcgtgaaatggttgaggagtggaaaaaatgccgagatgatattgtatattttgcagaaacatactgcgccattactcatatcgactatggtgtcataaaggttcaattacgtgactatcagcgtgatatgctcaaaataatgtcatctaaacgtatgactgtttgtaatttatcacgtcagcttggtaaaacaactgtagtagctatttttcttgcacactttgtatgttttaacaaggataaagctgtaggtattcttgcgcacaaaggctcaatgtctgcggaagttttagatcgtactaagcaagcaattgaactacttcctgactttttacagccaggaattgttgaatggaataaagggtctattgaacttgataatggttcctcaatcggagcctatgcttcctctcctgacgcagttcgtggtaactcgttcgcaatgatttatattgacgaatgcgcgtttattccaaacttccatgattcctggcttgctattcagccggtaatttcatctggtcgtcgttcgaaaattattattactacgactcctaatggattaaatcatttttatgatatttggactgctgccgttgaaggtaaatcagggtttgaaccatacaccgctatttggaattcagttaaggaacgtctttataacgatgaagatatttttgacgatggatggcaatggagcatacaaaccattaatggttctactttagcacaattccgtcaagaacataccgcagcgtttgaagggacttctggtacattaatttcaggaatgaaattggctgttatggatttcattgaagtaactccagatgatcatggttttcatcgatttaaaggccctgaaccagatagaaaatacattgcaactttagactgttcagaaggtcgtgggcaagattaccacgctttacatattattgatgttaccgatgatgtgtgggaacaggttggtgttttacattcaaataccatttctcatttaattctgcctgacatcgttatgcgttatttagtagaatacaatgaatgcccagtttatattgaattaaatagtactggtgtgtcagttgcaaaatcactttatatggatttagaatacgaaggtgttatctgcgattcatatactgatttaggaatgaaacaaactaaacgcacgaaagcagtaggatgttccacgctaaaagaccttattgaaaaagataagcttattattcatcaccgagcgactattcaagaatttagaacgtttagtgaaaaaggcgtgtcttgggcggctgaagaaggttatcatgacgatttagtaatgtctttagtgatttttggatggttatcaacacagtcaaaatttattgattatgcggataaagatgacatgcgattagcatctgaagtattttcaaaagagcttcaagatatgagcgacgactacgcgccagttatatttgtggattcggttcattctgctgagtatgttccagtatctcatggtatgtcaatggtataaatatattaaagcatattaaagaggattaaaaatgactttattatctccgggcattgagctcaaagaaactacggttcaaagcaccgtggttaataactctactggtacagcagctttggccggtaaattccagtggggtcctgcttttcagattaaacaggttacaaatgaagtagatttagttaatacttttggtcaaccaaccgctgaaactgctgactattttatgtctgcgatgaatttcttgcagtacggaaatgacttacgagtagttcgtgctgttgatagagataccgctaaaaactcatcgccaattgctggtaatattgaatacacaatttctaccccaggtagtaactatgcggttggagataaaatcacggtcaaatatgtttcagatgatattgaaactgaaggtaaaattactgaagtagacgcagatggaaaaattaagaaaattaatattcctactgcaaaaattatcgctaaagcaaaagaagtcggtgaatacccggaattaggttctaactggactgcggaaatttcttcatcttcctctggtttagctgcagtaataactcttggaaaaattattactgattctggtattttattagctgaaattgaaaatgctgaagctgctatgacagcggttgactttcaagcaaatcttaaaaaatacggaattccaggagtagtagctctttatccaggcgaattaggcgataaaattgaaattgaaatcgtatctaaagctgactatgcaaaaggagcttctgcattactcccaatttatccaggtggtggtactcgtgcatctactgccaaagcagtgtttggatatggaccgcaaactgattcacagtacgctattatagttcgtcgcaatgatgctattgttcaaagcattgttctttcaactaagcgtggtgaaaaagatatttacgatagtaacatctatattgatgactttttcgcaaaaggtggttcagaatatattttcgcaactgcgcaaaactggccagaaggcttctctggaattttaactctgtctggtggattatcatcaaatgctgaagtaacagcaggagatttgatggaagcttgggacttctttgctgaccgcgaatctgttgacgttcagttgtttattgcgggttcttgtgccggtgaatctcttgaaacagcatctactgtccaaaaacatgttgtttcaattggtgatgctcgtcaagattgcttagtattgtgctcacctccgcgtgaaactgtagttggaattcctgtaactcgtgcagtagataatttagttaactggagaactgcagcaggttcatacactgataataactttaatatcagttcaacctacgcagcaattgatggtaactacaaatatcagtatgacaaatataatgatgtgaatcgttgggttccattagcagctgatattgccggtttatgcgcaagaactgataacgtatctcagacttggatgtctccagctggttataatcgcggccagattcttaacgttattaaacttgctattgaaactcgccaagctcagcgcgaccgtttataccaagaagctatcaacccagtgactggtacaggtggtgatggttacgtattatatggtgataaaacagctacttctgttccttctccatttgatcgtattaacgttcgtcgtctgtttaatatgttgaaaacgaacatcggacgtagttcaaaatatcgtttgttcgaattaaacaacgcgtttactcgttcatcattccgcacagaaactgcccagtacttacagggaattaaagctctcggtggaatttatgaatatcgtgtagtttgcgatacaacaaataacactccgtcagtaattgatagaaatgagtttgttgcaacattctacattcaaccggctagaagcattaactacattaccttgaacttcgtagcaactgctactggtgcagatttcgatgagttaactggtcttgctggttaatacggtgcattctaaaggcctgtttcggcaggccatataaatacactatatccttaattctttaattctatatgccctaggttaaacatagggatataaatactacagaggctaatatgtttgtagatgatgtaacacgagcgtttgaatctggtgattttgctcgacctaacttattccaagtagaaatttcttatcttggacaaaattttacattccaatgtaaagccactgctttaccagctggtattgtagaaaaaattccagtcggatttatgaaccgtaaaattaacgtagcaggcgatcgtacattcgatgactggactgttacagtaatgaacgatgaagctcatgatgctcgccagaagtttgttgattggcaaagcattgctgctggtcaaggaaacgaaattactggtggaaaacctgcagagtataaaaagagcgctattgttcgtcaatatgctcgtgatgctaaaacagtaacaaaagaaattgaaattaaaggtctgtggcctactaacgtgggtgaacttcaattagattgggattcaaacaatgaaatccaaacctttgaagtaactcttgctctcgattattgggaataaaatgaatggggagaaatccccatcctgcttaaagcagagaagtccattataaatataactataattcccatttggagaatacaatgaaatttaatgtattaagtttgtttgctccatgggctaaaatggacgaacgaaattttaaagaccaagaaaaagaagatcttgtttccattacagccccaaagcttgatgatggagcaagagaatttgaagtaagctcgaatgaagctgcttctccttataatgctgcattccaaacaatttttggttcatatgaaccaggaatgaaaactactcgtgagcttattgatacatatcgtaatctcatgaataactatgaagtagataatgcagtttcagaaatcgtttcagatgctatcgtctacgaagatgatactgaagtcgtagcgttaaatttggataaatctaaatttagtccaaaaattaaaaatatgatgttagatgaatttagtgatgtattaaatcatctatcgtttcaacgaaaaggttctgatcattttagacgttggtatgttgattcaagaattttctttcataaaatcattgatccaaaacgtccaaaagaaggcataaaagaattacgtagattagaccctcgccaagttcagtatgttcgcgaaattataacagaaactgaagctggcacaaaaatagttaaaggttacaaagaatattttatatatgatactgcccatgagtcatatgcatgtgatggtagaatgtatgaagctggcacaaaaataaaaattccaaaagctgctgttgtttatgcccattctggattagtcgattgctgtggcaaaaatatcatcgggtatttacatcgtgctgttaaacctgctaaccaattaaaattattagaagatgctgtagtcatttatcgcattactcgtgctcctgaccgtcgtgtttggtatgtagacacaggtaatatgcctgctcgtaaagctgctgagcacatgcaacatgttatgaacacgatgaaaaaccgtgtagtatatgatgcatcaacaggtaaaataaaaaatcaacaacataatatgtctatgaccgaagactattggttgcagcgccgtgatggtaaagctgtgacagaagttgatactcttcctggcgctgataatactggcaatatggaagatattcgttggtttagacaagctctttacatggcattacgtgttcctctttcacgcattccacaagaccaacaaggcggtgtgatgtttgattctggaactagcattacacgtgatgaattaacgtttgctaaatttattcgtgagttacagcacaagtttgaagaagttttcctagatccacttaaaacaaatcttttgcttaaaggtataatcacagaagatgagtggaatgatgaaataaataatattaagatagaatttcatcgggatagctactttgctgagctcaaagaagcagaaattttggaacgaagaattaatatgctaaccatggcagaaccatttattggtaaatatatttctcacagaactgctatgaaagatattttgcagatgactgatgaagaaatagaacaagaagccaagcaaattgaagaagagtctaaagaggctcgtttccaagaccccgaccaagaacaagaggatttttaatggaaggtttaattgaagctattaaatcaaacgacctcgtagccgctcgtaaattatttgctgaagccatggctgcaagaacgactgatttaattaaagaagaaaaaatcgctatcgctcgtaatttcttaatcgaaggtgaagaacctgatgacgaggatgatgacgaagacgaagatagtgatgataaagacgacaaaaaagacaaagactctgacgaagacgaggatgatgaataatgcttctgatccctgaaactcatgaattagttctcgagaatgtcgaagcacttattcctgaagcacagggtcgctttgacgaattgtcttctgctttaaataaagacgatataaatacaattgtcgagaatatgcttgatgatgaaactgatttagcggttgcattagcttctattaatgaaaatatgccgttaaatgaatttatcgttaaacatgtttctgcccgtggtgaaattactcgcactaaagatcgcaaaacccgcgaacgtaatgcatttcaaactaccgggttgtctaaagcaaaacgtagacaaattgctcgtaaagctaccaaaacgaagattgccaatccagcaggtcaatctcgtgctcagcgtaagcgtaaaaaagctcttaaacgccgtaaagcattaggattaagctaatgaatgaaccccaattactaattgaaacttggggtcaacctggcgaaattattgatggcgtaccaatgcttgaatctcatgatggaaaagacttaggtttaaaaccgggtttatacatcgaaggaatattcatgcaagcggaagtcgtcaatagaaataaacgtctttatccaaaacgtatattagaaaaagcggtaaaagactatattaatgagcaagttttaactaaacaagctctcggagaattaaatcatcctccacgcgctaatgttgacccgatgcaagccgctatcattatagaagatatgtggtggaaaggaaatgacgtatacggacgagctcgtgttattgaaggtgaccacggtcctggagataaattagcagctaatattcgtgccggatggattccaggagtttcttctcgtggattaggttcattgactgacacaaataaaggttatcgtatcgtaaacgaaggattcaaattaactgtaggtgttgatgcagtatggggtccaagtgctccagatgcatgggtaactcctaaggaaattaccgaatcacagacggcggaagccgatacaagtgccgatgacgcctatatggctctcgcagaggccatgaaaaaagcgttataaatattattatctaaacaacaggactacaaaatgcttaaagaacaactgattgctgaagcgcaaaaaattgatgcttccgttgctcttgatagtattttcgaatcagttaatatttctccggaagcaaaagaaactttcggcactgtattcgaagctaccgtcaagcagcacgccgttaaattagctgaatctcatatcgctaaaattgctgaaaaagcagaagaagaagtagaaaaaaataaagaagaagcagaagaaaaagctgagaagaaaatcgctgagcaagcttctaaattccttgaccatcttgcaaaagaatggctcactgaaaataaattagcagtagataaaggtatcaaagccgaactgtttgaatccatgcttggtggattgaaagagctcttcgttgaacacaacgttgttgttccagaagaatcagttgatgttgtagctgaaatggaagaagaactgcaagaacataaagaagaatcagctcgtctgttcgaagaactcaataagcgtgacgcatatatcaattatgtgcagcgtgaagtggcattgagcgaaagtactaaagatctgactgagtctcaaaaagaaaaagtctctgctctggtcgaaggtatggattattcagatgcattctcaagtaaattgagtgcaatcgtagaaatggtgaagaaatctaataaagatgaaagcactattactgagagtataaatactcctgatactgaagcagccggactgaatttcgtcactgaagctgtagaagataaatctgcacaaggtgcagaagatattgtaagtgtatatgcgaaagtcgcatctcgtttctaattttaaaggttaacacaaatgactatcaaaactaaagctgaacttttgaacaaatggaagccattactggaaggtgaaggtttaccggaaattgctaatagcaaacaagcgattatcgctaaaatctttgaaaaccaggaaaaagatttccagacagctccggaatataaagacgaaaaaattgctcaggcattcggttctttcttaacagaagctgaaatcggtggtgaccacggttacaatgctaccaacatcgctgcaggtcagacttctggagcagtaactcagattggcccagctgttatgggtatggtacgtcgtgctattcctaacctgattgctttcgatatttgtggtgttcagccaatgaatagcccgactggccaggtattcgcactgcgtgcagtatatggtaaagacccaatcgctgctgatgctaaagaagcattccacccaatgtatggtccagatgcaatgttctctggtcagggtgctgctaagaaattcccagctctggctgctagcacacaaaccaaagtaggtgatatctatactcacttcttccaggaaactggtactgtatatctgcaagcttctgctcaagtaacaattagttctactgcagatgatgcagctaaattagatgctgaaattaagaaacaaatggaagctggcgcattggtagaaatcgctgaaggtatggctacttctatcgctgaacttcaggaaggtttcaacggttctaccgataacccatggaatgaaatgggcttccgtatcgataaacaagttatcgaagctaaatctcgtcagctgaaagctgcttactctatcgaattagcacaagacctccgcgctgttcacggtatggatgctgatgctgaactgtctggtattctggctaccgaaattatgctggaaatcaaccgcgaagttgttgattggattaactactccgctcaggttggtaaatctggtatgaccctgactccgggttctaaagctggtgtatttgacttccaggacccaatcgatattcgtggtgctcgctgggcaggtgaatcctttaaagctctgttgttccagattgacaaagaagcagttgaaattgctcgtcagactggtcgcggcgaaggtaacttcattatcgcttcccgtaacgtagttaacgttctggcttcagttgataccggcatttcttatgctgcacaaggtctggctactggctttaacactgatactaccaagtcagtatttgctggtgttctgggtggtaaataccgtgtatatatcgaccagtatgctaaacaggattatttcaccgtaggttataaaggtccgaacgaaatggatgctggtatttactatgctccatatgtagctctgactccgctgcgtggttctgatccgaagaacttccaaccggtaatgggattcaaaactcgttacggtatcggtatcaacccatttgcagaatccgctgctcaggctccggcttctcgcatccagagcggtatgccttctattctgaatagccttggtaaaaacgcttacttccgccgtgtatatgttaaaggtatctaatctttgacgatttaagggaccttcgggtccctttagttgtttttatggtataaataaatcatataaactgaaaggaaagcgcaatggctaaaatcaacgaacttctgcgcgaatcaaccacaacgaatagcaactcaatcggtcgcccaaatctcgttgctttgactcgcgctaccactaaattaatatattctgacattgtagcaacgcaaagaactaatcaacctgttgctgctttttatggtatcaaataccttaacccggataacgaatttacatttaaaactggtgctacttacgctggcgaagctgggtatgtagaccgagaacaaatcacagaattaacagaagagtctaaattaactctcaataaaggcgatttattcaaatataataatatcgtttataaagtattagaagatacaccatttgctgatattgaagaaagcgatttagaattagctcttcagattgcaatcgttcttttaaaggttcgtctattttctgatgctgcagtaacaagcaaatttgaaaactctgatagcgaaattgcggatgctagattccagattaataaatggcaaaccgcagttaaatctcgtaaacttaaaactggcatcacagttgaattagcacaagatttagaagcaaacggattcgatgctcctaatttcttggaagatttgcttgcaactgaaatggcggatgaaatcaataaagatattctgcagtctttgattacagtatcaaaacgctataaagttacaggaattactgatactggattcattgatttgagttatgcatctgcacctgaagctggtcgttcattataccgaatggtgtgtgaaatggtttcacatatccagaaagaatcaacttatacagcaacgttctgtgttgcttcagctcgtgccgctgcgattcttgctgcatcaggttggttaaaacataaaccagaagatgacaaatatctttcacaaaatgcctacgggttcttagctaatggtttaccgctttattgcgataccaacagtccattagattatgtaatcgttggcgtagtagaaaatattggtgaaaaagaaattgttggatcaattttctatgctccgtatacagaaggtcttgacttagatgaccctgaacatgtaggtgcatttaaagttgtagttgatccagaaagtttgcagccatctatcggtttattagttagatatgctttatctgcaaatccttacactgtagcaaaagatgaaaaagaagcaagagtaattgatggtggagatatggataaaatggcgggtcgttcagatttgtctgttttattaggtgttaagctaccaaaaattatcattgatgaataaaacaaagggaccgaaaggtccctttttatttaacttaccaattcaatccaagccggacgaagtacatcttgtaccattttaactaattccttcttaatcaaagaaggattatccgcttgagttagagtaataccttcacgagaagtttcttccaaaatatcttgaacagttagccccatcacctttccaaaatcttttggaccaatttcaccaattttagaaataacgttatttactcggttcagtgtaacgtaacaagctaaaattccaaccaatttgttatcagcttctgacagttcaactttagctttaataggcttatcagactttttcttttcactaaatttagagttcttgcatttgatagctacgcgattgccattaggcatccaagaaggataacaaggtttcaatacatatccttcagcggtaaatacttcgccttttacttcagcattccaaacgcatttatttgcatcaactaatccagcatggtctaccgtaaaattataatcctggacgacagaatctaaatcatttggcaatttaataagttcttcaaatttaccgcgacctaaaagtggagccattttaaatttaaatgtattacaaaatgattccatcatataatcatcgacataagtcacatcaccactttctgtagtgacaataatgtcaaatacataaaaatctttatcgccataatcgacattcttctgaatgccaggtccagcgaattcgccaaagacttgataagatacaaccgctgaggtttccataatatcttgtactgctttaatagaatcttcgtaattctttagaataatttcatacccaaagaaatcttcagcaggaagaattggtccagtacgtttagcgcaagttactttatcacgctcaataatcaatgagaaatttgtgccgtgaatcttttcacgagctacccactccccaccagtcaatcccaagctataaagtttttcaataaatttagaattgtaatgattttcaagactgctatactttttaaacataattaatcctcaaaatgtaatttctaaccaatcaccatcacgctgatcactattgactttaaagctgaatccttcttttctcagccaatcaccaatttcttcagtaatcaatttatcacgagcaatacaataataactaaaatgcgttttaccttgttcagctgctttattagcaagttccgaaaaatctttaataaaacattctagtttaaactgtttacttttaagtgctttttctcgcaattgattagcaaaagattcattttcataaagatcatactgttccatttttcacctttttattgatatgtctttttctatagacgactttttctcgagtttcaaatttattcttagcagtcatagctcgagcccataatacagccacttcttttgcctgtaagtttaattcacgagcaatttcaatgaatgactttccagactcatgaagcgtaaacaccacaacctcagttctcataattaatctcatgttatcgagttggtgccattatatacatcattttctgattgtgttttgcgtgctttcaaaatgaagaaaggggccgaagccccttatgattatggataggtatagatgataccagtttctaaagcagttttatgaatgatgtatccattacgcgattcttggacatcaacttctggatagtctttaatcatcttctgaagagtgtaacgatgcaggtagtatttactatctgggtcgtcagttttccaatctttaccttcttcggtcattttttggatttcatccataacccaccaaccgcaccagatataagctgaagtacgatgtggaagaggatgaacataaggtagttcaccttctggttcaattggagtccgttcagcaataacaacttcagctgttgaactaattgtctttgaagtgtaattatctttagttaatactgcttcaactttaattgtatgagtacccgctgaggaggtatcaatactataagtattagtagaattactttctgctacgttgtctttcttccaagagtacacaatattagtatcaccaggagcaccagtaacagatgctgttaaagttgcagttccaccaacagtagtattaactgatggcggagataaagaaatggtggcactattaaatgtcgcattattagttactactgttgcttctgctgaaatttcttttgtaacataatttgttgcagaaacagatgcggtgcatttaagagttttacttccgacttcggtcggagtgaatttatacgtagcagaagttgcatccggaatattactgtcatccattgaccattggaatgttatagtagcacctgaaggtgcactagagacatttgcagttaaagtaataggaacaccaaagactgtagtcggagactcgggtgtaatttttagcgtcgaagaattagcctttttatttacagtcaaagaaaccgctgatgattctactgttttatcaacgtaatcagttgcagtcactgtgacagagcaagttatagacttagttccttcagttgttggtgtatattcaaaggttgattgcttttgaccgtcaacatcgaccccgtcaactttccatgtataatcaatagcagcaccaataggttgattgcttacattagcagtgaatgttgttgctgttccaatttctactgccgcaggagaagccggagtaacagtgatagtggaattattttctttcttattaacagtgatagttgttgatgcttcagctatttccggatctcctgcggaaagtgtattagttgcaaccactttaatttttttgttcctgctggagaagcaagagtataatccattgtagcagccgtagagccctgtgttatatcatctacagtccagacgtatgtaatagtaccgtctggggtttcacctgcaggtgtagcagtgaatgtttgtgaacctccaataacccctgtaggagttagaggagataacgtgacagtgaatgccataagttatccttattttaatgttatgaaagaagaattacgagtttcgcgaattagaactgatccatcgcgattaatataataaattaagctaaataatgtttggtgtgctgacgcatgttcaaaactagttgggtgagatttccaatccggagtttcagcaatccattgataaatccaccaaggaacagtgcagaatcctggattttttccaatcagttgaagattcggactaaagttttccggaagagtaaatacagacggcttttcagattcaataatctcagctacagcctgttcgaatttttcttcaacaaacggagtgtcttcaatcaaaactgaggtattttcaggaattttatccgtttctactacttcaattttaatgtcagatttaaccggagaatcaatcaaaagtgctgcttctggattgacttcttcatcgtcatattttaatccctctgcagcatcagcagcatcaattaagtctttaatagataacccatcagtctctggcataggttcactagcgagcttctggagggcttcttcaatatcaacaacgatattatcaaaagatttgttctttttgacctttataccaaactgctcagcatattcagctaatttagctttagcttctttattatcatcaagagcctttaactctgcaatataatctttatctatcataatatttcctcagtataaatatagatatatttattactcggaaaatagtatgtaccactttgtatatgaaacaacaaatctaataaatggtaaaaagtatataggaaagcactctactgatgacttgaatgatggttaccttggttccggtaaggcaattcagcaggctataaagaaatatggtgaaaacaatttctctagaacaatactaaaagagtttaaaacttccgaagaagcgtacatgtatgaagaagaaattataactcctgaactaataaaaagcaaaaattattataatatgaaacctggtggaattggtggaattgttatgactacagatgttatagcaaagatgaaagaatcttccgctaaaagatttgaaaactcaccgggcacggtattaggtaaaacttgttatactaatggaactaaaaatatttttattaaacctggagaacttgttccagaaggatttgtaaaagggatggttcatcctaatagaaagtccagaaaaggatgtaaagtcaaaccgactaccacaggaactttttgggtcaataatggcgcaataaataaattaatacaaccagacggtattattcccgacggatttattaaaggtcgtctcatgaaaagagattctaaaggcaaatttagtaaggcataattatggatattaaagtacattttcacgacttcagtcatgtacgcatcgattgtgaagagagcacgttccacgaattaagagatttcttttcgtttgaggccgatggatatagatttaatcctcgcttcagatatggcaactgggatggacgaatccgtcttttagattataatcgtcttcttccattcggcttagtcgggcaaattaaaaagttctgtgataactttggctataaagcctggattgacccacagattaacgaaaaagaagaattatcaagaaaagattttgatgaatggctttctaaattagaaatctattcaggaaataaaagaattgaaccgcattggtatcaaaaagatgcagtgttcgaaggattagttaatcgtcgtagaattcttaatcttccaacatctgcaggtaaatccttaattcaagctttgcttgcacgttattatttggaaaattatgaaggtaaaattcttatcattgttccaacaactgctctgacaactcagatggctgatgactttgttgactatcgtttattcagtcatgcaatgataaagaaaatcggcggtggagcatcaaaagatgataaatataaaaatgatgcaccagtcgttgttggtacatggcaaactgtagtaaaacaaccgaaagaatggttctcacagtttggaatgatgatgaacgatgaatgccatcttgccacaggaaaaagtatttcatctatcatatcaggtttaaataactgcatgttcaaatttggtttgtctggttcattacgtgatggcaaagccaatatcatgcagtatgttggaatgtttggtgaaatatttaagccagtaacgacttctaaattaatggaagatggacaagtaactgagttaaaaattaatagtatttttcttcgctatcccgatgagtttactactaaattaaagggaaaaacttaccaagaagaaataaaaattattactggactcagtaaaagaaataaatggatcgctaaattagctattaagcttgcacaaaaagatgaaaacgcttttgtcatgtttaaacacgtatcgcatggtaaagctattttcgatttaattaaaaatgaatacgataaagtttattacgtatcaggggaagttgataccgaaactcgcaatataatgaaaaccttagctgaaaacggtaaaggaataattatagtagctagttatggtgtattttctactggtatttcagttaaaaatctgcatcacgttgttttagcgcacggtgttaaatcaaaaatcattgtattacaaacaataggtcgcgtattacgtaagcacggttctaaaacaatcgcaacagtctgggacctcatagatgattgtggcgttaagccaaaatctgctaatacgaaaaagaaatatgttcatttgaactatcttttaaaacacggcattgatcgtattcagcgctatgcagatgaaaaatttaattacgtaatgaaaacagttaatttataagggcttcggccctttggagaaaaagatgttactagaatttaaacaatttctttatgaagcttctattgatgaatttatgggtaaaattgcctcttgtcaaacattagaaggtttagaagaacttgaagcttattataagaaaagagttaaagaaactgaattaaaagatactgatgacatctcagttagagatgctttggcaggaaaaagagctgaattagaagattcagacgatgaagtagaagaaagcttttaaattaaaaaaggcccaaccaaaaaggaagggccaaaactatagactaaaggtcacactatagcaaaagttgtgtttcatttaattgttcttccgaactttctgaaactggtagttctttaatgtaattatagcaaggcccaggatgtacaggacctttgtctgtttcaacaaccaatgcagaatcgattggagttttacagacaacacaaatcttatctgacatgattgtctcctctgaattatatatctatttatacaactctcatatgcatatcaatgcccatatctttagaataaaaatactcatcaagatacccggcaaattttcctttaatataaaggacatcttcaccacacgggtgatcggccaggatacgaatatcctgacgcttaagattatgctttttcattaagaattgaatttccgtttcaaattcttcttcataattaaaagcatcatcaatgctatatctcattattttccagcctcaaatgctcgcatgtcttgaatatgcttaatagcaaatccacgcgatttaatagcatcaagagctccgctacagaaatctaataaaattccccaatattgtaatgaagtatcaacctttaaaacatccttatcagctgatagaactgtcttcatttctgatttctcgtaacgatccatactaaattcatcaccatctcctcgtcccgagtagtagtctaatctagctttaagagcaacttttttctgtgcgtcaattctaagcatttcctttttaatacttgaatgcttattaagccatttactatataacatcacattattagctgcttcatactgtaatttagtcgaatctataaacacatctttcttcaattcttcttgaagatcttctaatctcatattgttctctattcaattgttattggatggacttagattcattataccacgttttaacgtgaagcattatactctattactggaagccagctgcagttttatctgctcaatatcatcagggttatcgatgaccgaaaagcgtatttctactattagagtataatcgtcataaacgggtatcacattaactgataatttatcaatacgtggctcatagtttcttactgcgctttcaatattgcgctcaactgtgtcagcagtaagaggagtcatattttcaaaaagctggtctgataaatcacatccaaattcagggtcaaacggtcttgaaccttttcttgttgtaataattcccaaaagactgtttttaattgaccttaatccaagtgatctggaaacatctttgttccaatccattttcatttccgggtcaatatcagaataaagcttattaatatttgccattatagtaactcaaagaactctttgaggcctcttattacgtgagcatgggtttttccacactctggacacttaattggaacagccaaataaacggtaggttttaaaagcatatcttttatagctacaatatctgactctgtgatgatagaatataaatcttctagttccttttcatttaagtcttcaactggaatgctttccccgttagcatgaatcgtttctatgcatgatactatcatgtgggctatatttttatcatcaaaaattttagggtattggaatttaattttaatgtcacccagtgtataccagaggtcttctggtgcatctatttgtgtatgtaatagatttatatgggttggtatttcagttccacaggtgcacttccaagagttttcgtgattaacttcgccgagagaatgtgcccataaatgaatcagcagtagttctgattcttggcggtttaaatcttttgcatttgtgcagtctttgattagctttttaacaattacttctacagaaccattatttttggcagtaataagttctagatattctttaagcgtgaatgcgcgacaattgattattttagaaccaactctcacatcaaatttgtattcatacatatttagctcctttatttatcatatttataaatagaataaaaggagcatctatggcaaacattattcgttgtaaattaccagatggtgttcatcgttttaaaccatttacggtagaagattatcgagattttttgttagttcgaaacgatatagaacatcggtcaccacaagaacaaaaagaaataattactgatttaattgatgattattttggagactatccgaagacttggcaaccatttatatttttgcaggtatttgtagggtcaataggtaaaacaaaagtaccagtcacattcgtatgtccaaaatgtaaaaaagaaaagacagttccatttgaaatatatcaaaaagaattaaaggaacctgtttttgatgtagctaatgttaaaattaaattaaagtttccttctgagttttatgaaaataaagcaaagatgattactgaaaatattcattctgttcaagtagatgaaatgtggtatgattggaaggaaattagtgaatcgagtcaaatagaacttgttgacgccatcgagatagaaacattagaaaaaattctcgatgcaatgaatcctattaatttaacattgcacatgtcgtgttgtgataagtacattaaaaaatacactgatatagtagatgtgtttaagctattagttaatccagatgagatatttactttttatcaaattaatcacacgcttgtaaaaagtaattatagcttaaattcaataatgaaaatgattcctgccgagcgcggattcgtattaaaactgattgagaaggataaacatcaatgagtatgttacaacgtcctggatatccaaatctcagcgttaaattatttgagagttatgacgcttggagtaataatagatttgttgaattagctgctactattaccacattaactatgcgtgactctctttatggtcgaaatgaaggaatgctgcagttttatgattctaaaaatatccacacaaaaatggatggaaatgaaataattcaaatttctgtagctaatgcaaacgatattaataatgttaaaacacgaatttatggatgcaagcatttttccgtgtcagtagattcaaaaggcgataacatcattgctattgaattgggaactattcattctatagaaaatcttaaatttggtagaccatttttccctgatgcaggtgaatctataaaagaaatgcttggtgtcatttatcaagaccgcacattattaactccagcaataaatgctataaatgcttatgttcctgatattccatggactagtacatttgaaaattatttgtcctatgtaagagaagttgctctagctgtaggaagtgacaaatttgtatttgtgtggcaagacatcatgggagttaacatgatggactatgatatgatgataaatcaagaaccatatccaatgattgtaggtgagccatctttaataggtcaattcatccaagaattaaaatatccattggcatatgattttgtttggttgactaaatcaaacccgcataaacgtgatccaatgaaaaatgctactatctatgctcattcgtttttagattcttcactgccaatgattactacaggaaagggtgaaaactctattgtagtgtcaaggtcaggtgcttattctgaaatgacttataggaatggctatgaagaagctattcgtcttcaaactatggcgcaatatgatggctatgctaaatgttctactgtcggtaattttaacttgactcctggtgttaaaattatttttaatgatagtaaaaaccaatttaaaacagaattttacgttgatgaagttatccatgaattatcaaataataattcagtaactcatctatatatgttcactaatgcaacgaaactggaaacaatagacccagttaaggttaaaaatgaatttaaatctgatactaccactgaagaaagtagttcttccaataagcaataaagaagtttctattcctaaaatgggtcttaaacattataacattttaaaagatgttaaaggccctgatgaaaatttaaaacttcttattgattctatttgtccgaatttgtcaccggcagaagttgatttcgtttctattcatttattggaatttaatggaaagattaaatctcgtaaagaaatagatggctatacttatgacattaatgatgtttatgtatgccaaagattagaatttcaataccaaggaaatacattttattttagacctcctggaaaatttgaacaatttttaacggtgagcgatatgttatctaaatgcttgcttaaggtcaacgatgaagttaaagaaattaattttcttgagatgccagcattcgttttaaaatgggcaaatgatatttttacaactttagcaattcctggccctaatggtccaataactggaattggcaatattattggattatttgaatgaaaaagccacaagaaatgcaaacgatgcgtagaaaagttatttcagataataaaccagttcaggaagcggctaaatccgcttctaacactttatctgggcttaatgacatttctacaaaattggatgatgctcaagctgcttctgaattaatagctcaaaccgttgaagaaaaatcgaatgaaataattggagcaattgacaatgtagaaagcgcagtgagtgatactactgctggttctgagttaattgctgaaactgtagaaattggcaacaatattaataaagaaatcggtgaatcactcggaagtaaattagataaattaacgagtttactagaacaaaaaattcaaacagctggaattcaacagacaggaaccagcttagctgtagtcgaaagtgctattcccgttaaagttgttgaggatgatacagctgaatttgttggtccattattaccagctcctgaagcagttaataatgatcctgacgctgattttttccctgcccctcaaccagttgaacctaagcgagagtcaccggaagaaaaacagaaaaaagaagcatttaatttaaaattatctcaagctttagataaattaacaaagactgttgattttggatttaaaaaatccatttcaattactgataaaatatcaagcatgctatttaagtatactgtcagtgctgctattgaagctgctaaaatggttgcattaataatggctgttgttattggaatagacctactgatggttcattttaaatattggtcagataaattttcaaaagcctgggatttgtttagcactgattttaaaactttttcaagcgaaaccggaacttggggtcctttattacagagcatctttgaatctattgatgaaattaaaaagttctgggaagcgggagattggggcggtttgacggtagctattgtagaagggcttggaaaggttctttataatttaggagagcttattcaattgggtatggctaaattatctgcagcaattcttcgagtcattcctggcatgaaggatactgctgatgaagtagaaggaagagcattagaaaatttccaaaattctactggagcatctcttaataaagaagaccaagaaaaagtagcaaattatcaagataaacgaatgaatgatgatcttggcccaatagcaaaaggattagacaaaattgcgaactggaaaactcgtgcatctaactggattcgtggtgtagataataaagaagcattgactactgacgaagaacgtgcagcagaagaagaaaaattaaaacaactttcaccggaagaaagaaaaaatgctttaatgaaagctaatgaagctcgtgctgcgatgattcgttttgaaaaatacgctgattcagctgatatgagcaaagactcgacagttaaatcaattgaagctgctcatgaagaccttaaaaaacgaatgaatgatccggatttaaataattcaccagcagttaaaaaagaacttgcttctagatttgctaaaattgatgccacttatcaagagctcaagaaaaatcaacctgaagcaaaacctgaaacttctgctaaatcaccagaagcaaaacaggtccaggtgattgaaaagaacaaagcacaacaagctcctgttcaacaagcatctccttcaatcaataatactaataatgttattaagaaaaatactgtcgttcataatatgacacctgtcacaagcacaactgctcctggtgtatttggtgcgacgggagttaattaaggaataatatggcaattgttaaagaaataactgctgatttaattaaaaagtccggtgaaacaatttcagccggacagagtactaaatcagaagtaggaactaaaacatacacagcccagtttccaactgggcgtgctagtggtaatgacactacaggggacttccaggtaacagatctatataagaatggattattatttactgcatacaatatgtcatctagggattctggaagtcttagaacgatgagatctaactactcttcttcatcttcgagtattttacgtacagccagaaacactatcagtaatacagtatcaaaactatcaaatggactaatatcagataataattcaggaacaataagtaaagttcctgttgcaaatattcttttacctagatctaaatctgacgtcgatacgtcatcacatagatttaatgatgttcaagatagtcttattacaaaaggtggaggtactgctactggtgtgctaagcaatatggcttcaaccgcagtatttggagcgctggaaagtataacacaaggtataatggctgataataatgaacagatttatacgacagccagaagcatgtacggcggtgctgaaaatagaactaaagtgttcacttgggatttgactccgcgctcaacagaagatttaatggctattattaatatctatcagtattttaactatttttcttacggtgaaactggtaaatctcaatatgctgctgaaataaaaggatatttagatgagtggtaccgttctacttttattgagccgttaactccagaagatgcagttaaaaataagacgttatttgagaaaatgacatcgagtttaactaacgttcttgtagtttcaaacccgacaatttggatggtgaaaaactttggtgcaacatctaagtttgatggaaaaacggaaatattcggtccatgtcaaatccagagtatcagatttgacaaaacacctaatggtaactttaacggattagctattgctccaaacctccctagtacatttactctcgagattactatgagagaaattatcacgttaaaccgtgcttctttatatgcggggactttttaatgtattctttagaggaatttaataatcaagcaataaacgcagatttccaacgtaataatatgtttagctgcgtttttgcaacaactccatcaactaaaagctcttcgttgataagttcaattagcaacttttcttataataacttgggactaaattcagattggttaggattaactcaaggcgatattaatcagggaattactacgctaattacagctggcacacaaaaactgataagaaaatcaggagttagtaaatatcttattggtgccatgagtcaacgtacagttcaaagtttattaggctcatttacagttggtacatatttaattgacttctttaacatggcatataactcatctggattgatgatatattctgtaaaaatgccagagaatagattatcctatgaaactgactggaactataattctcctaatattcgtataactggaagagaattagaccctttggttatttcatttagaatggattcagaagcttgtaactatcgtgcaatgcaagactgggttaacgccgttcaagacccagtaactggattgcgtgctttaccgcaagatgtcgaggctgatattcaggttaatcttcattctcgcaatggattaccacatactgcggtgatgttcactggatgcattccaatatcagtgagcgctcctgagttatcatatgatggagataaccaaataactacatttgatgttacttttgcgtatagagtcatgcaggctggagcagttgatagacaagctgcgcttgaatggcttgaatctgctgctataaatggtattcaaagcgttctcggaaatagtggaggtgttactggactatctaattcgctttcacgactcagtagattagggggaactgcaggaagcatttcaaacattaatactatgacaggaattgtcaattcgcaaagtaaaatattaggagcaatataacaatggggacctttcggtccccatatttttatttacggaatgaaatgaaagcagcaactgaagcaactaaactgtcttcaatataaacttcaatttttaccggagcttctgactcaaatttacctgttactacaccctgaaaaatactttcagtctgttctggctttgaaaaattttcagaaggaaaaattccgaactttttatctgttccaaaaattttgataaattcatcgtaaactgcttcattaaaagcattatcagcaggaataacgccttcaactacaagttcttgacctaaaaagcgcaaagaagatttcattttgtgttcctcatgttatgtcagtaagactactataacacaacacgagggacttgtaaactacatcttgaactttttagacattccgttgatgttaaccaaagaagctaagatttgagaaacttcgttttcctcttcttttgattcttctacaaggaattgattaaatccagccattggacgaacttcaccagtttccatcaaatgatcgccatcatatactgattcttctaattgctcagaaggaggaacgattgtaccttcgattagatacttgttataagcagtttctttcataaagtaagtacttactttattaatcttcagtaaaattccacgcggtagaataacttcagcttctgatggaaatcctgataaatgacccggaacgataactttgattcgctcagctcctttaattaccatacccacgctagtttcagcatcttcattagcatatgtagaatgactacccatatgcatcaaatcttctgcatcaacggaaccttctccttcaccagaaaatactgcgccggaatcatctagagccatatagtttttaccatgctcaccgaagatatttggtttaagcgatgtggatacgaagttcttgaaatagaacattttattttcaatgttatgacgcaaagttttaaaggtaacttcttgtccacggtaaagtgtagttcctggaggaagaactgaacctttagcgaatgcagaatcaagcgtctcaatatgtttaatagctcgttccatatattcttcacgggtagaatctggtttacccaaaaggaacgagttcatttcaacatatgaatctgcacaataatcttcaattacatcagattcagcttgagttaatccttttggagttacttcagtgcttgcgtattcatatgcctgagcagcagattcattaatcaatttataaatgccattcatgacaaattgaataatagctgtcttttcatctggcgtagctttagaacctttaaccaaatcattgataattttcttaataacatcaaagctattagaaatattaatatcagcaagatcgcttaaaattttatcagtcttataatcaaagaattctttattctttaaatattcttgagaaccttgatatgttatatcgctctgtaacttgatagatggatcacgtaaacgtgcatgggctaatgcaatatgatttcggaagctttcgagttcataatcactagatttaaaacgagaagcgcttctcataccgcctatagctcctttgctgaagtttgaaccaatttgaataacgccagagttcattggtccttctgctttatacaccggaactttagattcaaactcttgatatttcttagcagcgaagctatcaccctgaagtgaagcatcaacagtagaatattgagcttgtgctgctaatcgacgactaattttagttttctgaataacagcttggtccgtgcgcttatcattttctaaagcaatagaagcagcaacagcaacagctttaggaacagcattacctgttttaacatctacataaacatcaccaacctttgattcaacttttgtgaataactcagttgaaataggaggtacacctggaatgtcttctaaattggcatttttacgataaaccataatatatgcgtactttttatcataatcccagatttcctttaaaagaacatatcgacctgctcctttagtacgtactaaacggtcagcaataacttgcatttgacgagcagcgccatttgttttactctttagtacgcggaataagcatgcatcaattttatactgtttcattgtttgaagagcagtatcaaaaacagcgttaatgacgccaattggatttccacccaagtttctaagtttaaccagtgataatttctcgttgacacctatcattacgatatgcatcattttatcgcccggcttaacgtttttatttgtatcacctccagaggtgtatgtacaaaatctaaatccaggaagcacgctttcttcgccggcttgaatagcaaaaatttgaggtattttatgcttaggatttaagttaacaaccggcgccgaagcgccgtcaaataattctgtaataagttccatgatttatccttgaacgaacttgtaaggcatgtttgcaatatctatgcaagacgcaataattccaagagatgattctactttctgtttaacatttgatgaaacaaatgatgcaaagtcaactctgtcttctatatcacctgtcattgtaaccaattcaccagtttccattaaatggtctccgtcatagattaccgattcggtgagttcttctgtggtcataacttcagcttgaataagcttgttgttagttctaactgttccatcgttgtaagatgcatcggttattttattaactttgaccattaatccacgtggcaaaatgacttccatttcatttgaaggcgctaaacttccaccgggtaaaacaacattaaccttatcagccccagtaataacccatccaattccaactaaattatcgctagaatttactagtccttcatcagttttatcaatagaaacacttagacgcttttcgtctggtaaaacacccacagatgaatcagtcatccaagtaccaaaaatatttggatataatgatgttgacacaaagtttctaaaataaaaaactcgattttttaccattgcttcgtatattgaaggtaacattcgttgtgaacgatacaaagtaataccttttggtaatcgttcaccatttttaaaggctgaatctaaattatcaatggcttgttctatttcaggtgctgttaaaatacttgtacgctcatctggattatataatcccaaaagagcattatttatgtctacatatcctgaacctacgtattcacgaattccgcgtttttgtgctggtgtgtatttagatgaatctttattttcgactataggatgtaatgaccatccagcggtaagagcatatccacgtaattctcttcgaataatctttgtttttattgcattccaagaattttgtactaactcatttgcagcatcttggtttaaatgcgaatgtctgttaatatttctttcaaaccaagcacctttatatttttctaaagtatcatcgacgatagaagcaatagtttctaaagtttttattgaagtaatagattcttttcgtaatttttctaaagctttattttttatttctgcattaataatggattctttatcttcaggaattatagaagcttctctgaatgccatcccagctgtaacactgctaagagcattctctagtgcaaatcctgaagtagaaattaccgttaattcattagaatcagaaattaaaggagcgtccgctggtttatttaattctgccgctgaagcctcaaatttttgaaacatcggtgtttcaaatctagaagattccaacgactgactttgtgcaattgctctacgggaaattttaactttaacgattacagcttgatcagaacgtttatcattttcttgtgcaatagatgctgcaattgcctcatttttagttacttgagctccagtatctttattgatataaacatcaccgaccttcgattcaactttagtaaagagctcagtactaatttccggaacccctggaatgtcttctagtgatacatttttgcgatgtataagaatatatgcatactttttatcataatcccagagttccttaagaaggacgtatctgccacctgaacgactacggataagtctatcagcaataacttgaatttgtcgagcttgaccagcagttttagacttaagaatacggagcatacaggcatcaattttatactgacgcattgtttgcattgcaacagtaaaaaccgaattgatataattaattgggcttggaccaagacctttcaatttagcaattgaacctttagcggttaatgtaaaaggaacaatatgcatcattttatcgcccatctttaaatcacgattagtatcacctccagatgtataggtacataaacgaaagcctggttgttcaattgcatcatcaacatgaactgaaaaaatttgtggtattttcttctttggatttaagtttgtaatcggaagagtagtatcttcgtcaaataattctgtaattagttccatcatatcctctctagtgtttattctatttataaaattaaaggcccgaaggcctttagtaatctagtggtaagagagtacgatatatttcaaactttggtcctttttcataggcatcaaatgtttctgtaaatttattataagcgtatgcatctacaaattcgagaatgacttgtgatacagaagtagaaacatctccaccttctttttgagcaatgacaattgtttctaagtaagctttcatagaccagttacctcatgaaaatcaccaaatacatcctcgaatgtattagctttagttttatcttcacgtaaacgaatcgcaatcggaagaaataatttaacgtaatcagtgcggccatcagattttaaccaaccgttgcattcgcactctagaatttttccaatataataattttggttttccataatgcgagtacggtcaagttcatgtgattttacaccggctttatcttttaagcctgaaccagcatttaccttaatttttccacactctgactcaagaataaatccacccgctttagtagggtctttacggtgaggataaattcctacaatttttaaatcaacatcaattacttctttaaatttatagagattttttgaacgagcattttcccataatccatcgatatttttgagaataataccttcaagaccttggtcaatatactttttataaattaccttagcttcatctaggttatttactacctggttttcaattaaaattactttatcatagcctgatgtcatttgttctagtttagaaaaacgtacatcatattttaaacgaaacgccggaagaccgtatatttctaccaacgggacataatcccagacctgaaacttcatgcattgagcttctttttcggaaatggttccctttaaagatttattagcgattccattagaagtagtacgtgattcagctacttcggcgaattctttggctttactaatttcaggataagcatcaaaaagaaaatctaggccttctggctcctttttaacttgctcatggtataccaattcgccatcaattaacacgccttctggatgaatctggcgggcttcagcggtcattttgattaattcttccttaagaagatctaatcctagatattcattaccggctcgtgataaaagacgaacatcatctaattcatcacctctgacttcggcaaagcaccgagctccatcagcttttaactgggcaaaggctggaaatttgatattcttattaatgcctttttcatcataagaacttgcaagcatttgaggttgttcaggaattaaacctggccaaactttgtttgcaatagatactgaagcaccgcattcaaggtctcgcatcatcacccgacgcaaaacttcaacatcatcttttttaccgtcagtaatatatccagttaattcctcaattgccgcatttccagtcaatttccgagtagctaacgtgaattcaatgaagtcaagcatatcggtaagagtcaacattccaaaactctgggtagcaatacccggtttaggccatttcttgatataatactgtaacccacgagaataagtcagacgatatactcgtttaagcaattcattatctttattcttttcaagaattgcttgcttctgcttagttgaaccaatagatgctatttcgttcagaattttaagaatcattgttcatcctttagagtttggtttacagctctattataaatcaattcatcattaagctcagtcaaagacctgtggtacgtggttctaactttatttccttgcatccagtgcttgacgtaaatgaaaccttgctctacacattttttaaaaattcgttcgtctttttgagctcggaattctggattgcatctaaaaaattgatttacgtgaccgtaatcacgtgtagtattaccttcattttcataaatagtgtgaacaacaaacattagaatgctccttggaaaatattatcaccactaccactaccactagtaagtctattaaaatatcctgcgtcgccaggcttaatataactccacgtatggaatggatgcatctgatgcgagtgtgtataatatggatgatatggattataaggattaaatccaggagttctccaagtagtgttccaacgaaaagaatcgtttttaatcatcttctcaattacatcttttataactttttcactatcaaaactttctttattttccttcgatggaaaaagcttattctctacatcattccatgtataaactcgctgtgcagtttttggaatactgtcacgttcccctcgagccatccaataaacaggaacatttaatatttcacttgcgtgatcgcagtggtgagcgagatcgtcaatataacaaattacgttatatttttcttttgcctttttgaacaactcttcttttgaagaatcatgaccacacatcagtacttctgagaaggcatcaggaaaaagagcattcaaattaaattgacgattcagcagagcgtcaatagaatcacccaatgctgtaacagctacaaaattataatcttcttttaatttgttaattacacatagggcatctttatatggagacaagtatcgaataaaatccgaacgattgtatttttcaattagcttaacgccaagttcttcatcgcaattaaatagtttaccaggagaaataaatttctcatcctggatcatttttaaaatatgttctaacggaagattatatttctgagcaaaataaggaaggcctgattgccagcttaaacatactccatcaatatcagttaaaatagtaggcttcatagagagtctcttaataggtttaacacatcaataaattcagcttcggttagtattgtatcatcttttgttagaccactagccatgctgtgcttcaaaacttttcctttcgaggcttgtaatgcatcgcgaaagcctctgttttgaagcgctgcttcaaaatacgcatttgtgtataattctttccaggctggggagtatcttgaaaacggaactccaagccagaagagggtcccacggtcctgagctctagcataagaccttccagcttgttgggcggcaagcccggataacccaaatatacgacgttgttgttcaacatttttcaccttgcacccttggaggaatccttcaagacctccaaattgaatgccatccataacgaaaggccattgggcgaaattacttaatgcgcatgatggccacctaaaattgcttctaatctctaactcagacattttcaatgcttataatttcaacatcagcccaatgaccacagtttggtagacgaaattcaactggccagtcactgcctttttctaatataatagacttaacttgcggttcttcgtgttcatcagtatacggatttttatctgttactttatatgtgaccttaatgtactgaattccaaaaatcttattaattatattcatactaattcctttaatccgtagataggagataattcatcgcccatacgaaggtcttcatttccatctacccaagaaacaatataagcctcttttatttgaataccactccatttaaacgaaggtagaaccttagaaattaatccaggtataccaactccctttaattcaacagtttgaccaaaaaagaatttcattaaaacctcatctaaaaaccgtgcgatttaacattaccgccattaatatcagaactattaatttcacgtgcaattgaagggtcaatgtcaatttcacgattgagtttagtgatagctaaagtatcgcgcccatttacagtacgaaactctaaaggacaaaccacatcaacgtagtttttaatcgattcgctagtaggttgcaaatgtgcaggaaggtctttaggcgcctttgagaaaactacttcgcagaagtttttacgggtatcaaaataagtagtcataaacataacattttcctcagtaaggggccaaagcccctcatttattttaaatatcaaattcgttaagaactacatcaaagattgcttcaagatgctcaggtttagctctgttactcagaatatgacgaatccaagttttaaccaaaagcttgcgattaacgccattccagcaaggatgagtccctaaatcgcgttcacggaaatcatcatccagagcgattttaaagttggaaccttccatcgtgattgaaaccgtgataccgttttcaaatcgcatataaacgtaattaggagtcatatactgctcaatttcgcatactgatccattttgatgtttccaaaggcaaatagtatcaatagaacctgcaataccattagaaacatatttacgttcaaagttgatgtagttcatttttattctccaagatgtttaattgcggtacaggtatataatatcatatcctgtaccaaagtaaacaattattttactactttccaatgctgcatgtcaagtttaccaacttttttcatcttctcaattaagcgttcggcacgttggcgagctgtaacataataccattcacctaattcattttgttcaatttttccaacgattactgtattcaattcataaatccaaccagtaaagaaattatgaacttgaattgtaaaggtgaaatctgttcccataccttctgttgtttctacttcaataatatcaccttcaactgccattaagaaccacatagtttcatcatatttaccattgaagcatttagttttaactgcagcgttcagattaatcgttttcattttattctcctttgtttgtgtaagataatactatcacaaaggaaccatactgtaaacaactttatgcaatctttggaaaataaaaaaggactcccgaaggagtcctcaacttatgctttctgcttaccaaaacgagaagcatcatctcgaagaaccgcacgtgctcggcgcatgatcttctcaacagtttgattgatacgagagttcgacccacgcttgtagccagcgcgtttagaatcaccaactttcttttcaactgctttctttgctttagcttgttttgccattataaattctcttttaaatgaaaatgcaggacttattggcattgcctgcgcaagccctcaaggggaacataggtttttggatatttaacgaccaggataaccataaacccgtcatcattcacattcaagaggtacaccgtaaaactgccggggtcttaaaactataatgattcgcaaatcattaatcagacagttcgacggctcctcgatttagctcacactaaggcagtgaatctccaataaattacttcaatgttaccacaaagtgacgaactgcttttcgcgcagcagaagccaaaggcttagcatatttaagttcatctttttcctgaagctcagcagctaatgcagtttgagcaggattcagatgtttgaaataacgcaggatttcaagagcttcggcttcaacatcaatagatgcgccatagttttcgtgaccattattccatgcgtttcgttgcagttcaagagcgtgttgtaattgtttaatcatttaaaaattctcgttagagattaaaactcggtagtcacgttcttctgaatttcatcttctttcgacagatctctcagttgtagactaccacatagaattgttcggttaacttattattccgacacccaattcatattattatttatatcacttataaagacacggaatagctttatagtgacaagtaacgaatttttgtttaatttcttttggctgcttaagacccagagctacaaaaggatgcggaacatttcgaatttgaccaactggaagagaagtcaaatcaccaacttcgcagaaaccttcaggaacatcaggaccgacagagtgaactacacacagttcaggaacttcaccttgaacacgtttaccgataataagtcctgattctgtaacttcttcatcaccggcttgtgcaggttcagaaactaaaataacatattcaccgacagcacgaattggtagctgttgtacttcagacatcgttttttcctttttgttaacagatgaattaataataacaaataattcttaaagcatttatttaccaataaattggagcaaatgctcaactttcataccattaacggaaatcaatttgtcaatagaaaaacctcgccatgcaccaagttcaacatcaaatactggaatcatgtcagtagattctttcccagtagattccgtcaatttaccagtttgcatggttggcataaagtctgcatcacgagtacctttcataacacgaatagtaccatcagacttttcaaaaactacgtttgaaacacccatggacaatttagttttcaaaatttcacgaattgctactttttgttcagtcgtcagtttcatttatttacctattacagttttaatatgagttgttccacgttctttaagagtggaaagtaatttttggcatttttctaaatcagatttccaactatatggtctatcaatacaaacccattctgacttataatactgcttccatttagagaaaaaatatttcttatactctacagcaaatgaaatattctcattagaataagaactaattgctgtgagctgtaccaaacgaaatttcattattcaccacagaattcgttgatattttcccagtttaacttattcaagtttttcttaggaacattaaacacttcaatacctgcatttcgcagaatatcatcccagccaggtttatttttatcgtatgtttcgcaataaaccagttttttaattccagactgagctatcgcttttgcgcaatccggacaaggagaaagtgttacatacatagtagcaccttcaattgaagaaccatttcgtgcagcaaacaaaatcgcatttagttcagcatgaatttcatttttagatgaccattccgagtgagcactacgatgttctttcgccaagacaaagcgatcagttgaaccaaatgatacacattcaggcttatgaccttgaatgatagtatgtttaggcttattcagcaaccaaccttgctcagcagcataatcacagcagttcacaccacctgcaggtgaaccattatatccagtagaaataatacgtccattcttttcaattactgctcctaccttccaggagcaacattttgattcttgtgatactaaatatgcaatttgaagtactgtactcgctttcatttcataatcaccagataagcagatttagcagtttcaacacgataaatttcgtgacgaagtttagttatacttttaataacagaactaattatattctgcccatctttaaagcggtttttcttatcaataaaaattgcaccaaccatctttttgtgaagctcaactggatacttcgtcacaataatagcatcatacacagaaggatgaatactattcaccaaagtatcattcattaaagttattctaatgaactgtgctgtttcagagtcaagcgctctatgatcgccagtatcattttcaagacaattatcaattatatcagttaaattcatcatagtacgccatacaccctttgtgcttcaactaatccatcaaaatccagtttaagatgcgatatttgatcgccatcacctggattcacaattactaatactgaacgaggagtttcggtaataacacgaaccgacgtttcaggaaatcgttcagaaaccttatttactaattcctgcgcaaatagtttaactttttcttggaattctttaacagtaattggtttttcacttagcatgttgatcccagctccttactttcaacgtttttaactaatttgacagaaactaattcagcatcttgagtaatcattaccggaccttcttcatactcttcaagatattctagagctttctttttagcttcttccttcgtatcagtttgagcatagatataaaacatacaaccagtaatacctactactttccacttaatttctttatcagttttaatttcaaatttactgacagaatcatctttttgaacttcttcgaaaaaagaatattctaacatataagcaattgaaaataacgggctatctttatagcattcacccattacatcaacagctttataccagcagtcatcaatttcgcgtttaatgctaataacatttttcgcaggatctatttttactttaaatgaattttccccaataaactgggcaattcgtttattagccccgcaagtttcattaaaaatatctttatacccagttttaaagcgataaaccttatcttcttcaaaccattcgctcatttcaatttcctcatttgttttggtagagctataatatcacaactctaccgtaaagtaaaccattaaatcgctttgaattccgcagtttgagattcaaagcgaatgtcgcctttgataactagctcagcatcaagaccgaatacaacaatgatatgcgcggaacctggatacaacgtaatggcaatagaatccacctggtctggaagcaaagtgttcaatacatgagtcacttgagcgtggattcgaagctcagctgcgttatcaagtttttcaaacatattattagcgataatttgactaaacactacttctacgattttagagtaagtcggaaacatatttacctcacataattttcttcgagccaatcaataacatccaaagcgttatcaaaagttgcgccatctactttgtcttctgtttcataatcaagaacatctaggcctactcttccgtcaacaataggccatagacaaaatagatatttcttttctttttcaattttatcacaaagacgataaatcttttctaggttattcatacgttttccatggtaaaggcagtttagttttctttactactagttcaacatcaggattcttttctcttaatttaaggcattcctcccatgctctattttcactagtaaatacacaaaattgcccattactagtaccaactaaaccgctatttacaataacaatagcccaagtttcatggtgccaagccattaaaaatctcccgaagcgacttgccagcattcaacaccgatgcggcgccacatttcaactacttgagttcggtcatcaatagctaatttcacatcaaaatgcggtgcgatgtgtttccagaaaatttcttctttaactacatcatctttacgggtatcgccttgttcgcgttgacactgcatgactaatggaacaccagcaatgtcctcaacccatttacgggtcatacgataatatttcgttggatcttcttcggttccactttcacggcctgaaacgactacgatttgataacccataagagcatacatcttggatagttcaacgaccattggattaataatatcggtatcgcatttttcaaggtcataaggaccacgatcattcatttttgctaacgtgccatcaacatcaaaaataactgcttttggtttaccaggagtccctttatataccggaagaccgagatactctcgcatgcttttatacattgaacgtaaaacatcaattggtactgctttagttccgcgttttgagttgcgtttaaccaattcagtccaaggaacatcaaacactttatgttcaactttccagccgtattctttggcaaaagtttcccatgctaggcgacgttcaggattcaagttagtatctgaaatgattacgcccttaacagaatcaccgccgtacagaatacttttagctgtatcaaactgcataccagttacgatgccttctttctttttggtatacttatactcatcgcgttcttcatgcgccataatagattggcgatagtcatcacgattgatattataaaacccgggattcttagcaataaattcacgagcccaagtactcttaccagaaccaggacagccaatagtcaaaataatctttttcatcatttaattcctaagaaaacttcaagaatacgaatattgtgctcacgccgtcctttgtacaattcagctgttgattgattcactgatttactctgaacattggatgaaataaattttatcatgtgatttttaagctgatacatatcaagcccacgagctttcgcttcttttcgcagggctttaccagcatcatctaaagctttagcagggtcttcatcatttaatactattccacgatccaaatccatgtatactgcaccatgacatgcatcaatgtaaaggtctgagcattcaatataacgttctagcagagttttcatttattttttctcaactaatgattgaatataatcatgcagatctttagatgctttgccccacttattttggtattcatttttaagattagcacgtgattgagctaataaaacatcattagttggaggtaaagattctaatcgctgaatctggcgtccataaatcattgcagccatctcggattcataaatcaatcctttgagatgttcaaattgatgccatgaaatcatttacatttatcctcttttaactcttgacgataataacatatcatagttttctggtcgtgtacatatcgttttacatcattaagccaaatacgaaattcctgagaatcttcaaatggcataccgacccaagctttaccatcaataactttaacttgccaagataatttagcttcgtcatatgactttatttgtacaggccaattaggatgaactgtttctttctttacttctagaggctttgtcgaacaaccaactagaagaccaatagataatattactgctgatagtttaatcatttagaaaggtcctggatgtcttctgcgaacttgttgaaggagttgttgatttgtttttcaaccaatcctggcttatgagccaccacatccgccttctttgcatctttgcgcagtttttcattttcacgctcaatagcagcaattgcctcacgatttttattattcatcgcatcaatataattatactgaattcgcaaattatttaatgctaaggcgttttcattggccgtttttgtaatttcagtaactgatgtttctaatctttctaccttattttttaaaataatagatgttccgccaaatgctattacaagtaatagcaatccagctgtaaaattacttacatgcataaagttttaataacctctataatatcgtcttgagaaagaccgttaattaaaatatgatgttcagctggagatttagaaattttaaagcatgcctcaacatcttctgccatatccgatgcactacgatttggattactaattccaagacgatgctttccagtcaaaggattaacgatgatatagcatttacaactattgatatgaacattaggttgagtctgattaataaatacatcacaatcatatttcgcaagctgattttctaaaaagactttcatctcttcaaccgcatcaggaagcatatcacgggcttgctcaagacgacgatttcgatattctttaatggtcgttttccgcttgacttgcttagctaaatctttcttaagatcggtgatatatccaactcgacggtttcctttaaatacagaaatcccatctgtagtatcaccgtatgcttcaacgaccatttcagtagtaattagctgcaaatccatcataaagtcctcatgttatgtcagtaagactactgtaacacaacacgagggacttgtaaacagcttagtatccttctgggataaattttttataatttttcaaaaaattctgttcgatttcacacataaccttctcttgactatcatacccctggtataagctcatgatgataccgaacaagtgatccattccagcacctttagcaacaccttgcgcttccattgcataagtctttctatctttaccacaatgcttattgtgacagtcaagaactaaaaacagagctcggtctaagtacttcagataagtcgtttcaaacgcctcaatttttctgtatgaatattcatcgtcagcgtacattgctttaagatcatctgatgcaccgtcaataatagtcttaaacaatttttctggattatctaatgaactttttgtactatgaagagacacataccagtcagacttaattttaaaatgagaaccatctttcatcacagcaacatagccttcgatgttttctgcatttttagcttcttctacccatttagggctatcgatttcgaatcgttcaactagatatggacgaagagcagcatctttataaatatcatcgtatgaaatgtattcacccgtttcgttttcacgaacattcagtaaaataattttcatttcttggtaagcaagaacgattctattcgtcggagcaacgaattcgaagttagcagtaaatccatcttcagctaattctttaagtctatcgcgcaaccgatgatgattaatattcatcaaaatcccattagccattaaagcctgctcagatttgattgaaccctttgatttgaacagaatttcatcaccatctaaataagttgataccaaagacccgtcttcttttgttagaatgtaatcaacatcatttaaatcgatattcatcgtgaatggattttcattcaagttaaaaaacttttccatgggacgagaggcaattcttaccggtttttctccatccatttcaaacataattccacgacattccagtgcatctggaagtaaccaatcagaataagatgcataattatatgagaaaattctgtaagttcttccagatgcacttacatcatctgagtaaaaaaacttacgctgtgaatccttacatagttccattaaattgttaaaaagttcttgcattgtgtatcctcttttgtgttttgaatatagtaccacactccatgtggaagcatcattttttcttatgttgaatattccaaggcgggttaaacagcttaatgaatagtggttcctctaggtcaatcgtcgcgattgtcattgtacctaactcatttgtcatagaaagattaaaacattggcgggcgtaaaattcaactttgcttccttcctttagcgcagaatgaattaatgcagatttagtagaatcagacgttttgtctttacgattaatagcagttctataatagtttattcttttacgtaaatttttagtttttccaatataaacaagctcatcatttatagcaatagcataaattacgttatacttgtttggaatagataattgttttatacttccgttgtcgtctaattctagctcagtatatttaataaatgaatattctgttgcaatttctttcataataaaatgggccttgcggcccactccttaaaagtattttttaaaactcatcataactttatcatcaacatcattatcaatctgtgcaacaaggtaagatgacaattctacttcttgtggcgcagattgaacattatcagaattaagatattcacgaatccaaggatatggatgtttaaccggagcatcggtaattgggcatggaagaccacactgcttcatacgagatacagttaagtaatcaataaagctccacatgctatttgtatttaatccaggaacatctccatctttaaataaatgaactgcccaatctttttcttggcggttaacttccatgaaaatatcaactgcttcttgttcacactcttgagcaattttaacccattcatcgccatcagtgccaagttgaagttgacgaataatatattgggtgcctttaagatgaagctgctcatcacgcgcaatgaacttcataatcttggcattaccttccatgatttccatgttcttatggaagttaaaagtgcatgcgaaagatacataaaaacgaatagcttctaaggcattaataacgtgcaaacagaggtaaagagatttcattaaagcacgtttagcttcggcttcttgtttaatagcttggtttaaacgaaagtcggcatcaggagattctttagatagttctacaaattctttagcattttcccattcacgagttttaatcagaacatcatcataataacgtccaatggattcagcacgtttcataatagcttcatctaatacaatctcatcaaataccttcgatggatcagtataaagatttcgcatgatatgtgtatatgaacgactgtgaatagtttcactaaaagtccatgtagcaacccacgtatcaaggcttgggtctgaaattaatgacataagtacagcagacggcgcacgaccctgaatgctatccaaaagtgattgatacttcaagttgttagtaaaaatattttgctgatactgaggaagcttattaaactgtgcagcatccatcattaagtttacttcttccgggcgccagaaaaatgataaggacttctctgtaagttcttcaaatactcgatgccgttgaatatcataacgcgcaataccaagacctgaaccaaaaaacataggttcttttaaaacatcaactgggtttgtattaaaaactgtgctcataaattttccacttagttaatagttggtgactcgtccgtgagtcaaattatatcataatttacaggatgaacaatcttcagcttttggagtttctatttcataatcatcagtaccagaaccatcacgggtattatgataatagaaatttttaatgccataataccatccgtatagcatgtcatcaatcattattgacattggaaccttgcctttagggaagatttgggggtcatagtatgtattcgccgaagctgattgacaaacccatttcagcataatagctacctgcgtaagataaggtttattacctttcttagctaatttccatgtatagtcgtaaaggtctatgttatgctcaatattgggcacgacttgattaaaggagccctcttttgattctttaacagagactggtccacgtggaggctcgataccgtttgtactgttagatacctgactggacgattcgcaaggcatcaacgcggataaagtagaatttctaattccatgctgtttgagttcagatcgaagttcgtcccaatcacaaacgtattttggagctgcgatttggtcaatctttttattgtaccagtcaataggtaattcgcctcgagaccaacgagtgtctgaataatattcgcaaggtcctttttctttggcgagcttaatggatgctttaatgagtccatactgtaatctctcaaatagttcatgtgttaaatcgttagcatcttcataagaagcaaagttacttgccagccaagctgcatagttagtaacacctacaccgaggttacgacgctttttagctttttctgcttcaggaactggatatccttggtaatccaaaagattatcaagagcacgaacttgaacttctgccaattcattaattttatcttggtcttgccagtcaaaattatctagtacgaatgcagagagagtacacaatccaatttcagcatcaggactattcacatcatttgttggaatagcaatttcacaacacaagttactctgacgaataggcgccttttcacgaataaacggagtatagttattcgtattatcaatgaactgcacataaatccttgcggttcctgaacgttcagtcatgagcaattcaaatagttcacgggctttaatgcgctttttacgaatattagggtctttttctgctgcttcgtataattcacggaaacggtcttggtctttaaaataagaataataaagctcgccacccatttcatgtggactgaacaaagtaatgtaatcgttctttccaaaacgttccatcatcaaatcattcagctggacgccataatccatatgacggatacggttttcttctacacctttgttattttttagaacgagaagattttcaacttccaaatgccaaataggataataagcagtagcagcgccgccacgaattccaccctgtgagcatgatttaacagcagtctgaaaatgtttccaaaaaggaataacaccagtatggcgtacttcacccatgccaatcttagaaccttcggcacgaatcataccaacgttaataccaattccagcacgtttggagatatattcaacaattgaagcggaagccttattgatagactttaatgaatcacctgcctcaataacaacacatgaactaaactgtcgagtcggagtacgacaaccagccataataggagttggtaatgaaatctgtcgagtagataccgcttcataaaaacggataacatgttttaatctatcaacaggttcatcttgatgcaatgccattccaatagtcataaatgcaaactgtggagtttcataaatttgaccagtggttttatctttaactagatatttttcttttaattgcatcgccccggaataagtaaattccatatcccgctcgtgcttaatttttgattctaaaaatgtaatttcttctgctgaatattttgacaataattcagggtcatatttaccttcatttacacagtaagaaatatggtcaataaatgaacgtggttcatactgcccataaacatgcttacgaagagcgaacattaaacagcgtgcagctacatattgataatcaggctcttcaaccgaaatagaattcgcagcagccttaatgacaatagtctgaatgtcatcagttgtcattccatcacggagatatgatttaatattttcatataattcataaggatctactgatgttccctcagatgcccaagataaaactttaataattttttgcgggtcaaagctctgagaaacaccactacttttgataacattaattaattgcataagtcctcaacttgaaaatcgtctttaaacaatcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattaacatcaaagtcagatttatatttattcactacctggcatagacggtccgcgcggtgataattcggcatattgtttttccgttaaaacagtaatatcgtagtaacagtcagaagaagttttaactgtggaaattttattatcaaaatactcacgagtcattttatgagtataatattttttgccataaatgataataggctgatttggtcctggaacttctaactcacttgggttaggaagtgtaaaaagaactacaccagaagtatctttaaatcgtaaaatcataaatcctcacaattaaattaaaattacaccgccatttttcctttcaagacgccgtgggactgataatctttgagaacgaaatctttaggcctgagtttaagaatgtattccaattgttctttagtagaaagatagcggaatttataaggcaatccgcctattaccagttcacaaagctctttaggttcacgacgcaaaatttctttacattgttctacgtgattcatatagatatgagtattaccaccggaaaatatcaaatctcccggaataagattacacatcttagctacaatatgaactaacgtagcatatgatgcaatattaaatggaagcattatgttcagataaggtcgttaatcttaccccggaattatatccagctgcatgtcaccatgcagatcagactatatctccaacttgttaaagcaagttgtctatcgtttcgagtcacttgaccctactccccaaagggatagtcgttaggcatttatgtagaaccaattccatttatcagattttacacgataagtaactaatccagacgaaattttaaaatgtctagctgcatctgctgcacaatcaaaaataaccccatcacatgaaatctttttaatattactaggctttttacctttcatcttttctgatattttagatttagttatgtctgaatgcttatgattaaagaatgaattattttcacctgaacgatttctgcatttactacaagtataagcagaagtttgtatgcgaacaccgcacttacaaaacttatgggtttctggattccaacgcccgtttttacttccgggtttactgtaaagagctttccgaccatcaggtccaagtttaagcatcttagctttaacagtttcagaacgtttcttaataatttcttcttttaatggatgcgtagaacatgtatcaccaaacgttgcatcagcaatattgtatccattaattttagaattaagctctttaatccaaaaattttctcgttcaataatcaaatctttctcatatggaatttcttccaaaatagaacattcaaacacattaccatgtttgttaaaagacctctgaagctttatagaagaatggcatcctttttctaaatctttaaaatgcctcttccatctcttttcaaaatctttagcacttcctacatatactttattgtttaaagtatttttaatctgataaattccgcttttcataaatacctctttaaatatagaagtatttattaaagggcagtcctacaatttagcacgggattgtctactagagaggttccccgtttagatagattacaagtataagtcaccttatactcaggcctcaattaacccaagaaaacatctactgatcgttgataccactgcaaatccaaatagccattacgcacattaaactgatagaacatatgacaaggcggtaatgccatctgcttgagttcagctggattccatgctgaaacaatttgacgcctatcatttggcaattttttaatacgatcaataacttctataatttggtctacaccgccaaaatcacgccactgttttccataaattggaccaagttcaccgctatggtatcctaaatcttttgcttgattttcgtaattttcatcccagactgttttgcctttgattaacgaatcatgttgaattaatcgcaaatcattgacatttgtgcttcccgataaaaaccaaagcagctcagcaatgcaagctttccaggcgagcttcttagttgttactgcaggaaaacctttagttaaatcccagcgtaatttagtaccgaacaaagcaattgttcctgtgcctgttcggtcatcggtttcgtagccattttccaggatatctttaattaaaaattggtattgtttcattagttcatccaagaatatgtagaaggatatttggcaaagttaggcttatatcctaatttaaccatttgttttgctttgcgagtaaatcctaaagaacgctcacctttaagatattgttttggtgtcataggcccttgatgcatctgccgacaaataaaaagggccatagcattaggaacatccttaacttttaatttattgctcatttatatactgattccgtaagggttgttacttcatctattttataccaatgcgtttcaaccatttcacgcttgcttatatcatcaagaaaacttacatctaactgaaccgttgaattaacacgatgccttttaacgatgcgggaaacaactacttcatccgcataaggtaatgcagcatatagtagagcgggtccgccaattacacttactttagaattctggtcaagcatagcctcgaatggtgcattagggcttgacacttgaatttcaccaccagaaatgtaagttatatactgttcccaagtaatatagaaatgtgctaaatcgccgtctttagttacaggataatcacgcgcaaggtcacacaccacaatatgactacgaccaggaagtaatgtagataatgactggaacgttttagcacccataatcataattgtaccttcggtacgagctttaaaattctggaggtcctttttaactcgtccccatggtaaaccatcacctaaaccaaatgctaattcattaaagccctcaaccgttttagttggagaataagcgaataccaatttaatcattacgcaaaacctctttcaacaaaccattcagtggctttattagcatcaaagaataattcttcataggtcttttctttgttttcaaagactgtcacacaaacacgttgacattctccacagtattcttctgacatactcaaagcgtcagaaaacatttcattaaattcacttaaattaggattatgcaatgcgttaaaaattgcataatcgaattcatcattcataaattcaaatacaaaaatcatattattttccttaaacagactttttcacaattttccaatcagctttaaactgctcgacgtcagaatggtaaatccagaatcctgcgctttctccatcctcataaagagggcatctatcacattcatcttcccatcccatatcacgtaaaagatgttcagctttttcaacaagttcagaatctttaccgatgatattaaaataccatttacctctaacttccgaatctttgatgctctgacgttgtaatctcattttattctcctcaagttgataaggctatagtatcattaccatagcccgttgtaaactactttttgaaagtttttcgcaaaagttcaatgatttcatctacattgttttcgtcaacaatgcagtgaatttttgttacgccagaaactataccttcattagcggattgaggcttttctaaagttacctcagtaaagtatttgaattcttcagagtaaatctcaaaatacgtctcaagtgggccacccgccatgtattcagtgccatcttccatagttacacgtaccacacattcaccagcacaatcatcactttccatttcatctacaacaaaactaggtccgtgcttctctattaaatttagcatcattacattgcaacggcactcgttagcaaagtcatttttaaataaagggttaatgatataagtttttccaacttccattttgatttcctcattttaacggggctatcaaatagccccttgataattattgttcaatcagtcccatgtaaaattctgcgtcttcagaatccatgccatcacaatattcattagccataaagcgggtaaggtcttcaagaggaccttcaatgacaatagaaaaattgcaataattgggatcatcatgaatacttgtgatactaagttcaggataacgattacgaataatctcttcaatatattcaaaatcaacgatgtcaatatcaactttagccatattattttcctctttaatcatcagcagtattgccgatagttgtatagtaccatggaaggacaaggatgtaaacagttttgtgaaaaaatttttgaaataaaaaaggggacctctagggtccccaattaattagtaatataatctgttaaaggtcattcaaaaggtcatctagatccgtgtcatcagcactagatgaactgccagagcttgagctcataaaatcatcttcagtttttgtattgaagtcatcaacattgaatgcatccaaatcatcagcaactttatcagctttcttagcagcagttgcagcggcaccgcccatcacagcagttcccataacttgaccaaatttagtgctcagttcttcaaacgatttgaatttatctttagaagtcatttcagaaaggtcaaccatttgttcgaacagttctttctggaaagattcatcatcaatgtttggaatcgcagattgattcaggaatttagattcatcgtagttactaaatccagaaacctgtttaactttcagtacaaagttagcaccttcccacggacaagttacatcaaccggagtttcacccatttcaacatcaaccgcaatcattgcattgattttatcccagattttcttaccaaaacggtatttaaatactttaccttcattttctggagcagctgggtcttttacaacaagaatattagcccagtaagaagttttacgtttaacaagaccgtactctttattgtcagtgttgtacagatcatttttactgatgtattgacatactgggcaagaatcgtaatcaccgtgggtagatgaacatgtttcaatataccatttaccatttttcttgaaaccgtgatttacaagaattgcaaatggtgcttgttcatcatttttagacggaagaaaacgaattactgcttgaccgttacccgcattgtcgagtttcagtttccactcgcctttatcttcagaagaaaaaccacctttatttccagccagtttagccatttgtgcagcgagttcagcagtagatttacgtttaaacatttttatttccttttaatttaattaacagttggtgctatgacgatgtatgacctcatagctggtcagtgagataattataatctatttataataagcaattaatacttgcaagatttcacagtttcaatgaaaacatttttagctttctgtgaatcaatatttaaaatttttctataagcttttaactttatagaataattgttccaaactaaattatcagtctgttcatcatgtttatcgattatatttaaaaacgaatcaagcaagataaacgtctcaaacgaaattatgttcgattgcagaagtttaaaaatataacttgactgaacttttggattatattcaaagatttctttaaaagcagaaacttcaacttttttactaaaataataaatgttgcgaatatcttcttcaaacttaaatttaatttgcttcaagcgtccgatatattcacgataaaacacaagtgcatcagcgtcagagatgtcaccaatccaagcatcttggttggcaaccaaattgcttataaagattaaagcaagttcctttaatttatatttttctgataacttctggaaaaaatacttatcccttcgcttttgataagcggcatcagacacccgcatgcaccaattatacttaataacatcatactttccattcatatgctgttttatcattaagtataatttataaactgatttaccatcaatgtatctttcaccaccagcaggcatgcggagtttaatcatagcagaaaatctaatgtattagttttttcacaacgaacaacagaaggacgtaaaagattttcgtcaatagcttccgactgaattttttcaattatacccgaaggaataaatttagcaaattgagtttcaggaatagagttttcttccaagaatgctgtcgtagcttcaagataactcattccaaactcttctaccattttttcaataataaatccattttcttgacgatcaagaagctttgctatttcatccttttctttcttaattgaaagttctttttctgaaagaccggtctcatcgaccggacgaatatcatttagagaaaactgtgtcataaagttcaactacctcttcagtttcagcttcaaacacatcacggttatctttatgatacaaagctaatagacgattaaacatcttaccatcaacgccaagttcatctttggcacgaattcgaatatctttaatcagttcattataaccggaaattttcagtttatggtcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccacgcggtggtaatttatatgaattatagtaattcacaatgtttgaagcaatattatcaggaatataatcaaaatcaattagaactaaattttctttataacgattatattcagattccgtgagaagcaccttagcttgctcacggtcattagcaatagcttcaacgattgaagttttcattgaaggagttcgttcaccttcaactctggtaaaccaaaagtcagatcgtactttaactgaagcaacattatcctttttgtcacccttaagaattttagtcatacaatcaatttcagcagaaccgcttttaattttaacccatttcttatgcatcggtgaccattgcttaacatttggatatttgtgaagttgagtaaagtcaccgtccgatgaaatgattaaaatcttatgtccttctaaagagaactttttaacaagaacagcaatgtggtcatctgcttcatacttatcaatatccataacaatgtatggcatataagctttcaattcatctataactttatgactggattcaaaataaccttcccagtcccaagtagattcttctcgtgcttttccacggtttttcttataataataagcgaaatcacgacgccagtatccagatttcgcgttatcaatacatagtacaattttagtgtatccaagcgtttttgcttttttgacattaaacttaattgagttcaatatcaaatgacgaaccatcgataaattaattttttctttatctgggaagtttaccagagcagttgaaagagcaatttgactaaagtcaataaagcaaattccttctttgtaatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggcgataaaataatcaacgtagctttagctgaccgtaccgtaggaactgacggtgttaacgttgattacttaattcaagaaaacacagttcagcaatatgatccaactcgtggatatttaaaagattttgtaatcatttataataatcgtttttgggcagcaacggataatattccaaaacctgctggaaattttaatagaattcgttggaaagcattacgtactgatgccgtatatacaaccgtatcatctggaccatatcaattaaaatccggagaagcaatttcagtagatacatcagttggcaatgacattgagtttactttaccaccttctccgcttgatggagaaaccgtaataattcaagatatcggtggaaaacctggcataaatcaggttaaaataaattcttcaaatcagagtattgtcaattttagaggtgaacaggtacgttcagttttaatgactcatccaaagtcacagatgatattcatttttaataatcgtttgtggcaaatgtatgttgctgattatagcagagaagctgcgattgttactccatcgactgcgtatcaagcacaatctaatgattttatcgtacgtagatttacttctgctgcaccaattaatgttaaacttccgagatttgctaatcatggcgatattattaatttcgttgatttagataaactgaatccactttatcatacaattgttactacatacgatgaaacgacttcagtacaagaagttggaactcattccattgaaggccgtacatcgattgacggtttcttgatgtttgacgataatgagaaattgtggagattgtttgacggggatagtaaagcacgtttacgcattataacaactaattcaaatattcgtccaaatgaagaagtcatggtatttggcgcgaataatggaacaacccaaacaattgaacttcagcttccgactgatatttctgttggtgatactgttaaaatttccatgaattacatgagaaaaggacaaacagttaaaatcaaagctgctggtgaagataaaattgcttcttcagttcaattgctgcaattcccaaaacgttcagaatatccgcctgaagctgaatgggtaacagttcaagaattagtttttaatggtgaaactaattatgtaccagttttgcaacttgcttatatagaagattctgatggaaaatactgggttgtacagcaaaacgttccaacagttgaaagagtcgattctttaaataattctactagagcaagattaggcgtaattgctttagctacacaagctcaagcaaatgctgatttagaaaattctccacaaaaagaattagcaattactccagaaacgttagctaatcgtactgctactgaaactcgcagaggtattgcaagaatagcaactactgctcaagtaaatcagaacaccacattctcttttgcagatgaccttatcatcactcctaaaaagctgaatgaaagaactgctacagaaactcgtagaggtgttgctgaaattgctacgcagcaagaaactaatacaggtactgatgatactacaatcatcactcctaaaaagcttcaagctcgtcaaggttctgaatcattatctggtattgtaacttttgtatctaccgcaggagctactccagcttctagtcgtgaattaaatggtacgaatgtttataataaaaacactaataatttagttgtttcacctaaagctttggatcagtataaagctactccaacgcaacaaggcgcagtaattttagcagttgaaagtgaagtaattgctggacaaagccaagaaggatgggcaaatgcggttgtaacgccagaaacgttacataaaaagacatcaactgatggaagaattggtttaattgaaattgctacgcaaagtgaagttaatacaggaactgactatactcgcgcagtcactcctaaaactttaaatgaccgtagagcaactgaaagtttaagtggtatagctgaaattgctacgcaagttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattggataatgttctaataactcctaaaaagcttttaggtactaaatctactgaagcacaggaaggcgttattaaagttgcaactcggtctgaaactgtagctggaacgtcagcaaatactgctgtatctccaaaaaatttaaaatggattgtgcagagtgaacctacttgggcagcgactactgcgataagaggttttgttaaaacttcgtctggttcaattacattcgttggtaatgatacagctggttcaacacagccattagaatcatatgagaaaaatggttatgcagtatcaccatatgaattaaatcgcgtattagcaaattatttgccgttaaaagcaaaagccgtagatagtaatttattagatggtctagattcgctccagttcattcgtagggacattgcacaaacagttaatggttcactaaccttaacccaacaaacgaatctgagtgcccctcttgtatcatctagtactgctacattcggtggatcagtttcagcaaatagtacattaactatttctaatactggaacggcaactcgtctgatttttgagaaaggacctcaaactggaacaaacccggctcaaacgatgacagtcagagtgtggggaaatcaatttagcggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattagcggaaattatggtttcattgttcgcaatgacgggtcagtaacgaattttatgcttactgcatcgggtgatcagactggcggatttaatggattgcgtcctttagctattaataatgcatctggccaagtaacgattggtgaaagcttaatcattgcaaaaggtgctactataagttcgggtggtttgactgttaactcgagaattcgttctcagggtactaaaacctctgatttatatacccgtgcgccaacatctgatacagtaggattctggtcaatcgatattaatgattcagccacttataaccagttcccgggttattttaaaatggttgaaaaaactaatgaagtgactggacttccatacttagaacgtggtgaagaagttaaatctcctggtacattgactcagtttggtaacacacttgattcactttaccaagattggattacttatccaacgaccccagaagcacgtaccactcgctggacacgtacatggcagaaaaccaaaaactcttggtcaagttttgttcaggtatttgacggaggtaaccctcctcaaccttcagatataggagcgatcccatctgataatggaataataggtaatcttactattcgcgatttcttgcgaattggtaatgttcgcattattcctgacccagtgaataaaactgttaaatttgagtggattgaataagaggtattatggaaaaatttatggcagagtttggacaaggatatgtccaaacgccatttttatcggaaagcaattcagtaagatataaaataagcatagcgggttcttgcccgctttctactgcgggaccatatgttaaatttcaggataatcccgttggaaatcaaacatttagtgcaggtcttcatttaagagtttttgacccttctacgggagcattagttgatagcaagtcatatgctttttctgcttcaaacaatacaacatctgccgcttttgtcagtttcatgaattctttgtcaaacaatagacttgttgctatattaactagcggaaaggttaattttcctcctgaagtggtatcttggttaaggggagcaggaacttcagtttttccatcagattcagtattgtcaagatttgacgtgtcatatgctgctttttatacttcttctaaaagagctattgcattagagcatgttaaactaagtaatagaaaaagcacagatgattatcaaactattttagatgttgtatttgatagtttagaagacgtcggagctacaggatttcctaaaagaacatacgaaagcgttgagcaatttatgtctgcggttggaggaactaataatgaaattgcgcgattgccaacttcagctgctataagtaaactttctgactacaatttaattcctggtgatgttctttatcttaaagcacaactatatgctgatgctgatttacttgatcttggaactacaaatatatctattcgtttttatgatgcatcaaatggatatatttcctcgacccaagctgagtttactgggcaagctgggtcttgggaattaaaagaagattatgtagttgttcctgaaaatgcagtaggatttacgatatatgcacaaagaactgcccaagcaggtcaaggcggcatgagaaatttaagcttttctgaagtatcaagaaatggcggcatttcaaaacctgccgaatttggcgtcaacggtattcgcgttaattatgtctgcgaatcggcttcacctccagatataatggtacttcctacacaagcctcttctaaaactggcaaagtgtttgggcaagaatttagagaagtttaaactgagggagccttcgggttccctttttctttataaataatattaaaataaaggggcatataatggctgatttaaaagtaggttcaactgtaggtggatctgtcatttggcatcaaggaaattttccattgaattcagctggtgacgatgtactctacaaatcatttaaaatatattcagaatataataaaccgcaggcagctgataacgatttcgtttctaaagctaatggtggtacttacaccggtccaattactattaattacggggtaaatagttatcttcaattaagtaataatgaaacccccattcgaattcgttctggtggcggtaccggtaatactcttgtagttggtggctcttccggcggtattagttttagacctgcaggtagtgaaatcactactggacaaattactattacaccagaaggtttgacaacatttaccagggctgtaacggctccatctgtaactgttacatctactccttccgcagcatctgatgttactcgtaaagattatgttgatggagcaataaatactgttacaacaaatgcaaactctagggtattacgctctggagacactatgacaggaaatttaactgcgccaaaccttttttcacagaatcctgcatctcaaccttcacacgttccacgatttgaccaaatcgtaattaaggattctgttcaagatttcggctattattaagaggacttatggctactttaaaacaaatacaatttaaaagaagcaaaactgcaggtcaacgtcctgctgcttcagtattagccgaaggtgaattggctataaacttaaaagataaaacaattttcacaaaagatgactcaggtagtgttatagaattaggtttaaaatatggaggaactataaatgggtctttagaggttacagaaaatataactggaactttaattggaaattctagcacagctactaaattgcaaacacctaggaaaattaatggtatatcttttgatgggtcaaaggacattaccttaactccatctgacataaatgtcaatagcacaacatttataaaaaataatggcgaattacctactgatgctaatttagatacgtatgggcccattgaagaatatcttggtgtttggtcgaaatctacttcaacaaatgcgcaaccagcaaataaattcccagaagaaaatgccgtaggtgtactagaagtgtttgtggccggccaatttgctggcactcagcgttatactgtaagatctggtaacgtctatattcgttccttatctgctaaatggaatggcgtcgatggtccatggggtgtgtggcgtaatgttcaagcgtcaactcgtccactttcacaaacgattgaccttgatagcttgggagaattagaacattgtggcttatggcgaaacagttcaagcgcaatcgcatcatttgatcgccattatccagaagaaggatcagccgcacaaggatttttagaaatatttgaaggtggtttatacacgagaactcagcgttatactacccgcatgggtatggtttatactcgttgtctcgctgctgcatgggatgctagtgcacctaagtgggaggaatggaagcaggttggtcatggcacaccagcgactttctatgatggagatctgaatgattttaaaactcccgggttatataatattttaggcactgatgccgttattaactgtcctacaggtgaaggtttgccgactgttattgttggtttgctggaagttaaacagcgtgcttctggcggtgctattttccaacgtttcactaccgcaggaacgggtgcaactactcgcgatcgtatttttgagcgtgcatatactggtggtgcgtggggtgcatggaacgaagtatatacatcttactctctgccaattactttaggtatgggtggtattaaaactcgattagcggagctagattggcaaacatttgattttgttcctggtagtatgtttagcgttcctttgaacaaaataaagaacatgccagctaatatgaattggggcacgattgacggaaacttaattatgttttctgttggtcctagcgagcacaccagcacaggacgtactgttcaggtttggcgtggaactgtatcccagacaaactatcgttattttgtcgttcgtgtgtccggtaattctggaaatagaacttgcgcagttcgccgtgttgttcttgaagatggatcacatacttggactgctcaacaaaactttaggggattgttgaatatcactgctgctgttaatcttggtgctaatcagaaaatttcacttgctccaggagcatatattcaagcccctgctagcggttctggttctaatacttacgcgaatcagaatactaccattgcaccattatatcaggccattgacgattcaaataaaaaccagtttgcgccaattgttaaacagaaaaacactgtaacaaatattactatggcttctggtatggatattgctagttcagaatatcgtatcgttgctcagggtgatttatccgctactggaactacagccactgaattagctacatggcgtttcttgccgtctggccgattcatgtcacaaagccgagtttatgctggcgcagcattcttgaacactgatggtaatattgccggttcaatctggaagaaatataacaatgcgacaaatttagatgctgccttgaatactcgcgtaggtaaaggcggtgatacgatgacaggtcggttaacaatcaatgcacctaatgattctattgtattatcaacgactgctagtaattctttgcatattcgtggtgacatagacgggactggtaactggtatattggtaagggtggtgctgataattcgctagcattttatagctatgcttctcaggcggcagtacatatcacaaacaatggtgagattgcgttaaacccgcaaaataccgcaatggttaacgttaaccgtgaccgtgtacacattaacggttctggatggattgctagacaaccgggtgattggggcaaccaatggcgagtagaagctccattattcgttgatcatggttatgtttcacaggattgttattatcctattcttaaagcaagaagcgttataaccaatcaaggatatagcaccgctgttgactttggtatgcgtcgtattccatcacagtgggggcaagcaatcattcgtgtcggatccacggaggcttctcctgatgctggacacccacaagctgtgtttgaattccatcatgatggattcttttatacaccaggaaatggtagctttagcgatgtgtatattcgttctgactcccgtctcaagattaataaagaagaattagaatatggagcggtcgaaaaagtttgccgactgaaagtttatatttacgataaagttaagtctattaaagaccgtagtgttattaaacgtgaagttggtattattgctcaggaccttgaaaaggaattaccggaagctgtatctaaagttgaagttgatggatctgatgttctgacaatttctaactccgctgtaaatgctcttttaattaaggctatccaagaaatgagcgaagaaattaaagaattaaaaacgcctttcttcactaaaattgctcgcaaaattagtaattattttaaattctaacaacaaggggctttgcccctttggagaaaattatggcagtagttggtgttcccggttggattggaagttcatccgtaaatgaaacaggacaacgatggatgagtcaagcagctggtcaattaagattgggtgttccttgctggatgagccaattcgccggacgctcaagagagattattcatactgtaagtgctaatcataattttaatggtcagtggttccgtgatagatgctttgaagctggcggtgcacccattgtattcaatattgttggtgatatcgtttcttattctaaagatgtgccacttttctttatgtatggggatacgcctaatgaatatgttgttcttaatattcatggtggtgttcatatgtggggtcgtggtggtaatggtggatacactcactcaggaggcgacggtaacggtacacaaggcggtcatgttattcaaaatgatatcggtggacggcttcgtatttggaactacggtgttatagctgctggtggtggcggtggtggtggtattgcatatcgtccacactcaggggcaaactggcaagatatcggtggcggtggtggtcgacctttcggtggcgctggcggcggccgttattccggtggtgctgcttcgtatgaaggtccgggtggtggttatgactatggtaacgcacactccggcgctggtggtaatgctggtgcttctggtcagaatgcatggtctgacggcggtaaagttcttaaagttggtgttggtggtgcgtctggtcatgcagtgtttggatcttctccaacttggggtgctgttggaacaatttacggaccaagagtataatttgaataaatatccttaaaaggagggtctatggcagcacctagaatatcattttcgccctctgatattctgttgggtgttctagatcgcttgttcaaagataatgctaccgggaaagttcttgcttcccgggtagctgtcgtaattcttttgtttataatggcgattgtttggtataggggagatagtttctttgagtactataagcaatcaaagtatgaaacatacagtgaaattattgaaaaggaaagaaatgcacgctttgaatctgtcgccctggaacaactccagatagttcatatatcatctgaggcagactttagtgcggtgtattctttccgccctaaaaacttaaactattttgttgatattatagcatacgaaggaaaattaccttcaacaataagtgaaaaatcacttggaggatatcctgttgataaaactatggatgaatatacagttcatttaaatggacgtcattattattccaactcaaaatttgcttttttaccaactaaaaagcctactcccgaaataaactacatgtacagttgtccatattttaatttggataatatctatgctggaacaataactatgtactggtatagaaatgatcatataagtaatgaccgccttgaatcaatatgtgctcaggcggccagaatattaggaagggctaaataattatttgttcgtatacatctctagatatcgatatacactctcaaacccctcgttgaattcgtcgatgagggttttcttatcttcttgggttaattcagaaacaattttacggaataaattctgatttaattttctaccttcatgcgttactccaatctcattcagaaatgcaataaaattagcacgattttcaacaatatcttctctggaaaatttaatcaaaatagatgcaacagtaataatttcacgaactgtatcaatgtttttattcattaactataccactcaattagttgactttgttataatatcatcagacacttgatttgtaaactggtctgtgttattttcttcaaaaattttttctacgaattccttgaacgactcacgttcctgagctgcattatgctcgattaccatttcaagattatgactcattcgaaataatcttcaatttcgtaatcatggacataaatcattatagtttttaatacatcatcaatactttttcctggagctggaattacgtaaaaatatcctgcttttgagaggtctttataagttccaaccaagaaatcattattctcgagatgtaattcttcaactaattcattaacaattgaatggtataaatttggtagaaacttatatagcttttctagaatatcaattttgattgtatattgaaccacagattgagaatcaataatcatagaccttccccttatgtttctgtttgcgattagattctttaaacgctttcttcttatccttatgaacagaagctttattaaaattatgttttgcgactaaattgttcatagtgctgaattacctctcttaaacatttgcatgtgaatgaaaactttttagctacaccacattcaaatatatgttctcttaaatcacgtgtatcagtatatcccatctcaacaataaaatgccttattagatttttatctttatcattgagagaattaaaataatcagattttgaattaatttccctggccaaattgaatcaccttcagttgacgttttagctcttttatcatctcttcgttcatcgcaatataaagatcgcgtaaagcaggttttatcattccatttattggggaactaaatgggcatacataatcttttcctacgagctttttggtgaattccatatcacagaactgaaatgccggttcattggcataaattccccaattagttgacatcattttattggcatattccaacgcctggatttgattcttaattccatcaatttgaaactttttaatattcattagtaaaggtcctcagagtaaagttctttttcactaccaccgcgttcaatacgtacttgtccggcgtaagttgcaataatcattgcttcttcacgtgtccagtaattgctatactgatcaataaacccttggtcatcatcacaaacttgctgagtaactaattggggtttaactacatctaaaacttctgccatatctttagaataatgacgagcacctggaataacaagagttcgtccatcttttaatttaaaacggttggcggcacaaacaattcgtcgttgatacttttggtttcatcccagtatgcggtctgccaacagatttcaggaacttcttttagaatatcttcttctgtgcatttataaccatgcgctttaaatttttcaacaagactttctggagtttcacgacataaaggaacattcagcatttttaaacgattaataaatgggttcatttaaaccatcctttaatacgctgccacaaagttttctgttgagctttgttaacaccaattgagcgaataactggttgagattcctggaattctttataatcagcaaggtaaatttcgtaagctgcatccgtaaatgaacttatcgccgccataaaattattgcgaatacctactggagcatctttactttcacgaataatcatgtatttaccagtcttaatctttacgatagttccaagataagccccatggtaccagatgtcccacccctcctgagtgggttctgcacaacgacgaagttcattgacaatttctaacttgttcattatttattcctcacagttcagatgctacagtgattacagcttcaatgttttctgccgagcgtttaatgtcaagatacacattaccgtttttagcgattttacatgacattccgatgtcagtaaatttctgaatatgatgttccatcattttgtatccaaaaattcgcatatttccattgttgttaatttcaaaattacgaattccgtgagtgcgtttttctaaaatagcgagatagttactgcggtaagtttcaacctttttaagaacaaatccattttcatctaaaagttttaacatgaagtctttatcttcttccatatcagaagtaatttcgcgagctttacgagttgctcgttttttcagcagttccggagcgttttcctgtgcgtataaagttgctgcatttgaaataatatcctgagcttcaccagtaatgattaatccatcaccagatttctccaccaggccttttttaatcaataccccaatattactattaactactgcattacctaaatctggatgcacctcacgaacttctgcagctgtaatgaaatctttcttagcaatggtaattaaaatcgcagcagttttttcattcagaacatcgttagaagctttgatgatgtaagttactttagacattttaatctccgtttcagttcatttatttgataggtctatagtatcatgtttaaagcagaagtaaacacttttttgcactctttttcaagagctctaataaagtacttacttaatgttcagattacgaacttcgatttcgtcttcatgggcaaaatcaaactgtttgaattctgtgtcacctttaaatttaaaaatcattgtgaagaaagtcagaacaccaggtttttcttcacgaactccacagatatcatattcaataccatctacaaccagtttgttagcagtcagagcatttttagctttaacgatttcgttttcgattttaaatttcatttttgtatctccgggttgtttgtttcagttcatttatttgatagttgtatagtaccacagtatgctttggttgtaaaccgttttgtgaaaaaatttttgaaataaaaaaaagggagagccgaggctctccctaaaattactgcatgactgtgataactgtcatgataacacgttgaattccgaacgcaagaagacctcctgctacggcaggaacaacacctaaacccgccagtaaaatgccaccagatactaatgcagcgcttgtgataccaatgaatggactcatttgatttcctctaaatctttggtgtattctgtaactacatcagtagttttccaatattcgttttcttcttttttggctttagcttcttcagcaagtttctttgcttcgtcggaagtcatatgaaaaatgttcattccaactagtttatcaacataagaagaatacatatcaattttagaaagttcttcggtcagttctttgcgagttttaccttgtacaacaatttcacctgaaattactttcttaatgaaatgtgccttggcaaaagctaaacgaaatgctgattcagtttctttgattttgttatcaattcgtttttggacataagttttacgaacttcaacgaagtctttgattaaatcaactacattatcgtaaacttgcagctttcctttctcattaatgacggtaatattctgggaacgacgctcaatcaacccgaagtctttcataatttttgcatggcgttcttcttcgttatcgctcaaagagtattctttacggaatttaactttaaagccaaacccatgctcaccacaagcatcatcccacgtaataaagcctttatcttcaagcgggtctaaaattttgctcacgtaagtttcacgatcatacttatacggaatctcagtgatatgcatttgagttcgtgaagtaaacttgtacgttccacgaatttcatattgaccgtcaatttcaacgacttcaccgcgaaattctggaaattctaccttcggtttagttactttctttccttgaagagcttgcaatacagctttcttgacagaagaaacactatgaggaagaatataagttgcataaccagttgcaataccggaaacaccattaagaagaacagtaggaataataggcaaatagaaagcaggcggaatgtgttctttatcttgatgtaccggagcatattcagtatctttatatacgctatagaaatttttacttacacgagcaaaaatataacgacttgccgctgctttttgaacggtacgagaaccaaagtttccttgaccatctaacagaggaaagttattattccaagtattagccatcaaagcacctgcgtcttgtgcagagttttcaccatgatgatatccaaggtctgctacaccacctgcaatagaagcgagtttgtgaaacttatctttatttcctcgtgccaaatcaagagctcgagcaataacaaatcgttgaactggcttaaatccatcaatcatatttgggatagcacgattttcaaccgtgtacatagcataagccaatgcttcattatcaatgatactttttaaatcacgattattcagttgcataaatttaccatactagtgaatgtagtgccataataacatcagaaatgaaaagcacgacttgaattaatccgaacattattccgtaatataatgctatcaataaaatagcaagggctaatgaatagcccaagattttcttaatcattagtagataacaacacaaatgttaaatatgcacacataccctgagctaaagcttgcgaaaacacactgctggcatcaatacagatagttaaaacacatgctactatccaacaaataaatgaaataactcctaataattttgcaatattcatattttcctcactggcgtccgaagacgcctttagttttaagattattacgatagaactgcatcacgtgttcgttgtggaaattactcattaatatgcctgcaaaacgaatttaaagttatcagccaacatacggttcatttcttcaagtgtttgatactcggaatgatgattacgggtaaacgccaaagctaactgacctttaccaaatcctgtcgtcagaggtttcatcttagaagcaggcagataaaatactgtgtataccatattgttatttgcaatagtacgtgcaagctgagaccgacgttgacgaatatgacttagaactgcactgaatccttgcttagaacgctgattacctacataaaatcgtgcagacacacatggattactaaatggacgaccatctaatttacttactaaaaagtaaaatccaggtttagataaaatatctttatgcggagttcccaaaaaccactcaccacccttgattgtaccaataacagtagcgcctgcattattcagatcagtaacagtcatgtatttcatattaatttcctctaaattattttctactccaaggccgcatgaatacacgcggccattaaattaatcgtcgcagtcgacgttcaattcccaaaactcttctacggtataagtttcagtatcattttcaatacagaaacgttcattactgttatttgctaaagtagcgttaactgtcattttctcgctggtgctcttaagaggtgaaatacgaattaactgatcaccactatccaagcaaaaaatttcaccaacttttacatctttaaagattttcataattcacctcaaggagtataaaatccaaatgcagttgttgaccatcccatccaatatggaaaatttgcgccaatgtaaaacataagaatataaaaccaaccactcagcaaattcatcattttacaccattccaaattgtttcaaccacggattttaaaccattttgatgaatatccattccgactaccgtcatcaaataaattccaactacaactgaacctaaggcaaaaatcagcatgaaaatgaataaagccggaaaaatattatcgaaaaaccattcaataaatgtaaaagcactgcgtttacgcttcatattttcctcacataaatccaaagtaaacgtttaatacatcaatcattaaaacgattgggaatatactcaaaactattagtattataactacattccatatagctttaacaatctttttcattttctgttcctccgtagttgatagggtaatagtaccacggaagaacagtcttgtaaacaactttttttaaaaatattcgtaataaatgtgaataccaatcactactgccgaaacttgtgcaacccaccatgcacacgcaataagtacagaattcaaaattttcataataacctcatcacaaaagtaaatgttaaacaaattactggaatactaattaaccaaacaaaacaccaacataatgaactcatagttcaatctcaacgatttccaagtgtttttgttttattgcctttttaacacaatcatggactaaatatgaccatgaatcattatattctccattaactaatcgttggagatcttcacgtgatgataagtaaggttgatctgattcccattttgataaaaatactgcagtaaaaatatctccttcatctgtagttgaagtcgtaaatgcaataaattcaccggtaattttatgtttagcgtaataaaatttaaatttcatttttactcctccgtagctgatagttgtatagtaccacggtccttgtggtatgtaaactgttttgtgaaaattttttaaatggaaagataccatccattgtagttgctttttcttacaaccttacgaaggtcttctctgtcaccgatgaacttcggagtgtattggatgacacctggatgaatttctttagtgttgaatataattatacagtcagcgacttgatgatttagaatgggccctagatttattccagaaccgtatggatactctccgctgcatcctgttgttacagaaatccaacgtgagccagtttgatgtgtcttaacttctacacgaagcccacagtattttggatgtgctaaaacatcccacgcgtatgtatatggatcatcgacatcttcttgacctttattaacatacccgcttagccaatctgctacaaaaaactctgcgcatacagcaatacgacatctttcaataacttctgctttatcctggttcgggttttgttttaaagagtatcttgcagtatcagcaattttgaccttcatttcactagtcaagtcactgttcgatagggtaaatgtcggaatctgaaatagtctctgtaaacccggattcgttttctgcatttagactttcctttttaccactgagataagcgttatatactttaagagtgccgtaataaattcggtcattttcatctaaagactcgcggtcaagttcatcgagctcctttttatccatgactataacatcattacagtaaagaaacccaagtttttcgtgaccaaactcaaatttattacagtacacaatattagcgtgatgatttccgtgcagtttaatctcttttatgtcggaatcaccgatattcatacaataaatcataatttttccttaaaacaaaagggccgaagccctttattttacttgaattgtgcaattcttttctctagacattcagcataagatttcattgagatgaactgtgaaagtagcagttcttgctcaactacactaactgttagaaactttgcgctttctaaaaatttactcagtgcattaattttgagcattaattgatcgtattcttcttttactcgtgcttgataacctaacataattttccttagttaagggccgaagcccttatttaaattgttcagtaacgtcttcaactacttcgtattggcaggtacgcattttagcgtcgttgtaatcaatcggaattgataccacatcgcgaggatgcactttaacttttacgactcggctggttgaactgccaaagtgacgaatataagatttagaacacacatgcagaccacgagaacaagtttgtgtatcatcgtcattcacacgagtacgtggcattttaactactttacccggactgttatcaaaggtatttgagtgacagtcaaagtaattgctgcgaactactttccaagcatagaagtagccatcttctgtaatttcaatatcgtttgctaccaagaaatcaaagagtcgagataccgctttttggcttgggttttccagcagattttccaagaacggaaaataaaattcaaagttttcgcctttttccatcgagtcaagaatacgatcaaccaaaccagaccgcaattcaatattttgatagaacaagcttccaccttcaattcgaacatcgccggaaatatatttttcaacagcgcgacgaacattaattttttgtgctgcttcttccagcttatccgctacaagcagattaagaatttcctggaagtttgaatgagtattaggagttgcgttataagttacaccgtcaacagtaattgaaatgaattttttagatgcattccaaataatgtcagatttagcaactggagcaataactgcatcgctattaactttaactgtaatatcaccactaatagtaactttagggcgtttagcttcttcggcatttttcaaaacacgacggattgtatcaaccgatacaccttgccaatcagccaattcctgttgggtgtaattaccacttgaatacagtttaacaatttcagcttgttcgtttttggtcaggcatttaatattgtacataattttcctta

SEQ ID NO: 10 - DNA, 38861 bp, artificial sequence
  BP1155
agcggcattaccgatggtcgatgactgtaggtagttagactgtaggtagtgactcaaggtctgatacagatagagactcaaagacagaccaatagtccctacctatcgtccttccctaagccataacctagacctatcgtcgacctaacgtcttgaccattggtccagccttatgatagactggggtagggcctttggtctggactgaaagagggcctatggggagacttgaggttctttaactgtgagatgtggtctcaaactttttgtccaaaactcatcgtccctccttaggaaccagctactgtaggtcaaggaccgtaggtctaagaccatcggatgacgaccagtgaaccaatcagtaggtagaccagaggtgagagcctgaatggtgttacctaaagtccttgactacagtagctaaggtcagtagagtgagtctttatccacgtactgaccttaggtcttccgctcatgaatcgttaccatgattgcgttaattacactgagagaccagagaacatacgagagtctcgacccacccgacccactgacttccagcagtaacgccagcagcaagtagaacagcagcaagaaacctgtatgtagctcgattggtcgccagagctttaagtacagctttggtctttgccatatgctacatacctcctgtatctatggtcggtgactatctgtattggagggattatgattaatatcaccctcattccatcggtgcaagccttaggtaagaactcggagtctgcctcctaaggtcttgcataaagtctgcatatgtatattcactacagtaatactataagtaaccgggggtcttccctatagtgatagttaagtccaaactccttataaaacagtaggttagactggtagtaactataggttactaaccgcgtattcatgcagctttcacccatagttattcattcagctagtggaacgtaacatatgaccctagtcccagctcgtcgtccgtatcgtgagttacccggaccccattgtcccagaactcagtgtggatggactcgaagcctttccgtgggttctccatttgttcctccagccactcctcagtgacttcacgttcgcctttgttggcatccttagccatcgactcaacgaagaactgtacaccgatagccagggcatcaagtcggtcatcgtgtgccaaggctccacgttcacgagagatacgggtcatctggtagaagagagagtagataggattacgaacaccatccttgtcagcagcggtctggtagtcctgaacgatagccgaagcgttgacgataagtctgtgagaccccatgataggctccagaacgtcacagatgcgtagttctttctgacccttactcttcacttcagttacagcagcaggatggatacgggcagctacaggcttgaataactcaaggtacataccatcaccgaagttaccctcaatgacgtactcgttgaccttccacttacgaccaatcttagccaaggcttccagcgtagagtcttcataaccaccacgcataccacctacttccatagcgaagatgtagccgttgagctgatacagtaccgcataaccagtttcatccttaccacgaccactagggtcaatgaccagaatcttctgggtgtatgagctgaaggcagaacctacagtctgatacgtgtggtacgagtcacccatgagtccaacgttaggaacgtcctcacgcttgttctgagggttcggcaaccattggtagaccattgggctggatgctgggtccaagtctgctacgataaggtcacggagcttcagagggtacttctcggcatcactcaggttcgggttaagcatgaactgtagagcgaagccggctttaccgtaggacagctcacgttccttcaggtcagtatcgtcgaatcgaacttcatcggtcggacgccagtagaaggactcagggtcctcttccagctctgcctgaagcatcggagccagacggtcgccgtaagactgccagtccttcttatcacgtggataacgagcaggccagatagtagtggtgtatccacggccttccagctcacgatacaaggtcatctcgttctgaggagtacccagatagatgattgtacctcccggcttcaggatagcgtcgaactctttcacaagctctgacagacggtctcgtgcagcctgagtcgctgagttgttcggaacctccacgtcatcggcaatcaggatgtcagcacgactaccagtcaactgaccagtgataccaacggacttaaccgaaggtgagtggtctggcttggctggtccaacgtcgaagctgataaccgcatctcgctgcccctgcttaggtttgagttcctgaagctgaggcatgaggtcgatgattcgcttgatgaagatggagttcgcatcggctcgttcctttgaggccgacacaatcatgaacttcaagtctgggttgttccatagtttccagaccacgaaaccacaggtcagaaacgatttgccaatacctcggaacgcctgaaggatgaagcgtcgattatcgccagcagccagcttcttacacatatctatctgacatctggttggaaccggaaggctcagcgctttccagagaacgaagatgaagaacacgaagtcgtccctcatcctttgggtcatttcagcctgtctttcagcaggtgttttcttagacatagagtccctccagcattaggtccctgacagagatagccgtgtccactttgtagtaatcacttaacaccttggagcctccttattgtgtcctgaagcgccttctccttaaggtctgcctcctgagttattcggataagacttttagaagtttctgggtgtagttcgactctaccattagggaagcatcgactgacatctgactcggtgagacctgaggtgttgactttgacgcgcagccgcttgttatcgcggttaaggtcagcaataatcctatcagtgctgccttccagcgaggacatttcgtcctgaaaccgcttggacactttgttgacttcagcttggacagcaagccttgtatcttccgatgccttaagattcgaggtgtattctgcattgaccttagcctcccacttattgttagcggtgtggtagccaccagcaaacatcactgctgcaagtaaccacggagccgctctctttaaaaattcgagcatagttgccctcccggtttatcagatttcacgtagagtcgcctccactagttagtgttaaccataaaggccactacatatagtaatgaccttgagtctaacacttattgaacgccatatccagtgtcattatcctcagtcgctgaaagtaccttatcgtactctgcgttcagggcctccatatcagcgagcgtcttctcgtcaacagacaccttgcttagcacgaagttgtgacgagccagtagcttctcaatggcgttgtaaagctgaggtgaacgcttagtgtcgtcacgtaagtcttgcagcatgagtcgagcacgttcagtatctagcattaagaggaacttctctaagtccatctgcgtcatgttttaccacctcctttaatcgttttgtagactagcacaccaatctggacaacggtgtacgcgatagctgcaacgtagaaccattcgttcagtgtaagtccgaagaagaaccgactggcaccatcagccgcagcggtcccgacgataggagaggctttaaggacctcattcttgaagtctaactcaatcataaaacctccagtttaaagcgggtcgtccgtgacccaaagttgttaacagttccgtcctcagtagtcagagtaaagagatgggaaccatcagagccattgatgtttgatggtttttagcaatcacgccaacaaccgcaaagacaacagcagcagtcactaaaacaacaaagccaacaaggaggcagtgagcctccggttgattttgatgattcaatacccttctgatgataaaactaacccagcttcggcggggtttaatcaagagaaatttatgattatttctggcaccctttccgtcgctgtcctagtgaggttagtcatcttgtctgcaatgaaagaccagaatgatgactcttagatagcagccatgatgaagcagagcagttcttcatagcggataccaaagttttctccggcctccagtgtacacttcatttctccggtatcatactcttcttctacttctaccatctttgttgtaacagtcgtagttcctgtcatgtcgtctacttcacatacttcttgttctttaagtacagtgcgttttgcgtagataggttcatactcagcatcccaagtatcatgacaataaaaagcgtacatttcagggttaagcccatgcttgcgtagaatattaccaacagattgtgctcccacgccgaagtggtaacgcgccccgtcgcctttattctcaatagcatccttaaatctaaatttccagatattggactttatctctagcgctgcggcacgttcggcttctaatatatcaacccgctctttaagtttttcgttggatgtgtttatcgttccagtacccgcgtacaccactgaccatctacgtgatgcggtgccatttgataaggtgttgtcagtgcctggtcttatattagaactaacgacgacttcggttgatgcattaagctgaataatccctgagttaatcccaaatgtaccaccgccagtagatgaagttcccccactagatgaaattctcgaatcgtaatcgtttttgttgccgcttgagtggaagtcaatataagtggtgcctgccgtggtagtgcttcctaactcaatcgccgatgcagcggcactcattgttagcttatcattctgtaaattaacgtctccggatgttaaaatagtagttgagcactttggtatctcgaacccagatgcgatcgacgtcacatcggtaaacgctacaagtattttgctgtacgatgctaacgcgtgccccccattcatgttccctatacgaaaggcgtttctccatcggaccgtagctgtcgaaagattcgacaaggcaaccccaacgtctacggcgcttccttgtacgtccccaccaccaatgacctgaatccctgacctataccatacagacgacccttcggaggctactgtgttaaactcacatgcggtcacgttatatacaccaacggcggatgggctcaaactaccgtgcatattcccgccaaagtacccacctttgaatgtgctcggggacgctgatactgcccctccgtcgccattttgagacactgccaacccaaccacacccacatagttacggtccgggttgtcggcactggtaggtgatttatgggtagatacaaattctgccgcgtgcctgccacctttggctgcggtgccaccgaaaacatggtttacctgtagcccgtcaacttttgtccccgccgatgtgtcgtcaacggcgttaacctggtcatctacaatcgctaggtagttaaacttcgcagtactggcatttggtattacgcctgtaatagggtcattgaggataacacctagtccgtatgttaacccatcatttaggtattctgaactgcggccctgcatgatcgaaaatcggtcattagcccgggctatcacccctgaagtgatcaggctggcgccgcctggtgcagctactaaatcctttcttaacgaatcagcgattcgtcgcgcttcgtcctcgctatccttagcgttgccagcagagctaccagcagcatcggcatattccttcgctaagtcaacagtttggtctcgaccttcttctgcaatatgtatagactgaagctctgcattggtcagatcactagctgtcaacactgagccattcctgaagtctaccactaagtcagttccagtctgacggtgaatacgaacgatgtcgaaacctgattggtcagccaacatctcaatcatcgttggattaaggaatcggtaatctcgaccaacttccagtacacggttcagggcagggttagagctattcaccagcgtaacaacaacaaacgttctggctaggtagtcgaactcaatcctgtaccgagtgtttcctgaagggaattgtgtaatcgtggacattatgcctcctttgtgatttaaacggagacctatggtagcgcctccagtttcctatagtgatagtttagtccttgatgtggatgccctgctcctcaaacgttccaagcaacagcttctgggtaatggggtcgttcggaaccagttcacggaacgtattatacatcccggtcatgtagtcacgctcgttgacacgagtatcagccttgaggtagccagccaagttgtaggccgaaacgccaacgttagcagcatatccgaaagctggaacctgctccaagaagttaccaacaacattcatcacagggtcacttgtagctgcaccaaacgtgatggcacgttcaggcttctctgtaggtgagcggggtagtatagacgaacggagcatcttagtgtcctcatacccagcgatgccacccagaatgttagctaccccaagtgggccaccaatatgtgaactacgggacagagccgcataaccaatcatcgtcgggtctagagcttgcttaaggtagtcacggtctcgaccatcctgcatagcgtaagccttgacgtgcgcctgagccatgtagtagatgccagccagacccatagacatcacggtcgacagtgcagcgtcaatcgctctgttgttcttcgtggcgttatagaaggttcgcatggttctcccattgatggacttgatgacgaagttcttaaactgaaggacagtcttagcgataggaccataagccttggcgtccatgttactcagcttgtgtggacgaagcaatgtctcgtcagcgatggtgtcacccatacgccacaggtccatagcccttgggtcctgactgaacgccttcttatccttgatggtatacttcccgtctggaccacgagtcactgactcacggattagggacttaattccattccactgctcgtcagatataccagcggtcttcaaccagcggtcatcaaacttacgcttacttcctgtcaggctgtgctccacgatgtcagacaagaagccctgacgtccggcatccagcaggtagtttgtcgtaccgttgaggactttagtgaacggagagcgtactgcaagttcaccagtgtaatacttggcagtcccaatagctgtagctgtcccacgacctaggtcactgtaagaccgcagacggtcaattacatcctgtttagacgggcgtattgagtcatcaagttccttaccaaagataacattgtgcaggtccttaatctctgaggccccgaccttcttgttacggaaggctaggtcacggaaaattgggactccatgtagcagcgcacgaacgttgccacgagccagcataccaccaatctccgttaagttctgaacacccatgtaggcattcttagcgaagaacgataggtctgtcattgtgcgcatcacagtagcgaaggctgcatcatcagcaccatcacgtcgagcacgaccagtgagaatcttcaatgtgtcacgtaaggtagatacctcacctttcaacttaccgtcatcaccagccttgttcatcatggtctcaaccaagtccttcatttctttcgttgtcttgcctgtaccagccataatagcaatgtcaccattaactcgacggttgtatgccgggacaatcttgtccatgtcccactcacgcaggttgttgacactgaaggtttgaccattaggaagaactattgacatatcgctgtcgaacaggttacgagcctcaaggaagctgttgttctccagacccaccagaccattgatgttctcttccattacggatgaacgctcgaactgctcggtgtgagagataccataagccttatcgttggcgtacttatcgaccgcagccgcaagtccttctggagtcaacgtagggtcagcctctaagagtgcctcgtccacacgattcttgacctcaggtcgagacgcatagctggtcaaccatgacttcttgatggcctcctgcaacgcctctggacttccaagctccttgatgtacagctccttcatctggttgctatacacatgtgggacgtaggttcccttgaagcggctacccggaaagatagactgagcgtctggacgaccaaacatcgccgggttctccatcatctcacgcttggcgtcaaactggttcttcagcaggtcatagactttcagttctcccggagtcagttcagccttcaggttcccacttccgtcttcaatagccatagacacacgctggtagatgtcctgacggaatgcgccagagtctcgccagaatgctgtctggaagtatgggtccttgagcgcctcagtaaccgcgtcgtcgatgtcgttgtagaaccgatggtccacagcacgaagtctctcgaatacgtcagacgcagtggtcccgattttacctgaggccccagactgcataccagtcggtgaacgcactaagtcagcagctactccacgaatctcagggttctcagaccgaagcagcttcaggccaatctcagtcagaccaccaaggttcacaccagcagcggcccgttcaggctcaatcacttcgtcaaagaccttacgtgtcttagggttcagagggttctcaccaatcaggattgaaccatcctccagccgcacactaccaggctcattcggaacgtcggcgaacttaacgccttgatgactaaaggtctgctcaccttcctgaatagggagacgagacaggtcctgaccatcaatgttacgagcggtctcacgagcttccagacgtgtagctgggccagcgaactcattagtgttgcgacctaaggctctgcctaaaccatcagcgatagcagtcatacctccaccgaagagagcaccgccaaggatagcctcagccacatgggcatcaccaccagccactgaggtacgggccatctctgatacaccagcaagtgctccagattgagcagccacggtgaacatcttgttgaccagcttgccacccttaccaacctgtccagcgataggaacgtaggtcagagggtccacaccagcgccaatcacaccagcagctaactgagcaccggtcccagccttggccttctcttggtccaacttctggttctcaagcgccaagttaataagctcggtcaggttctgaggggagccaccagtaatgaccccgtaatactgaggtaggaccccagcgctacgaatctggtccagctcctcacgagaccacttatggttgttccagcgggtcgggttaaacacatcgccaatgacatcaagtgagtcctcggtctgaccggcgcgaatagccacgccgaccatagagttcttcacttcagcttttgtagcctcaccgaaaccgaaccacgtagagcggtcctctcgttcctgcagggtctctccagtagccttatagaacatctcgccgaacgattcgttgggagcttcaggtgtttgaccctcaatgtttagaccagcagcggtcggaaggttctcgcccagagctactttaggtttagccttgagtccttccgtgagtgcgtcaaatacgttagcgcttactggtggagtctttgggctaatgccattgagtgctcgtgcgactcccttctgatagacttcagggtcgtaccgggagcctgtctcatggaagctgatagcttgagccagagaagacagggtgtcagggtccgataggtcgagactctgggtagctggaataccagttgcagccaccactgagtcaatataagccttagtgtcattctcgttaggaggggcccatcggttgataatcttctcgatggagtcataaccttggcgaccgtaggacagcaggtttttacctaaagctcggacgccagactctgggctatcgaaggtgacgaatgcgccatcatctccagtcattccttcccattggtccttacttacccggatgttacccggattgttattgcgaataccacgagtcgccattatgttactccttaccaattagtacgtttgcgataccctccagtgagacgtcattatacatcccaccgcgcttctcgatgttggcctctcggtcagctcgacgtttgtcaccagcagctttagtcccgactatacgcgctcgcttgttagcgtcacgttctgcctgagagtatgcagcatcttgtgccttctgctgttgttcgcggtagagtttacctacaagttctttatcgtagcgaatacgaatagtccctgtagcgtcttggaggaagatagagccattctgttcaacaacggacaactgagagttcactacccaagggttagccttaatgagctgcttacgagcggtgtcgataatgtctcgaccaacctgccacgactctgggttatccccgaccataagctggtgcttcgacaccatgccgatggacttaccgtcagaaccttcagactggaacgttacggtgttctcattcagccagcgttgagtctgctgagttgcagcgtcagcgttacctgtacgatagtaccatgagtcccagaccttacgagcacttgcgtccagagacgtaggaagacgcgaaaggtccttattccgagagtcgttcttcaactcctgccacgccttgtctgactccatgcgcatctcacggctttgacttgcagcttgcttatcagcttcaatcatcgtctgagggtccagacccatcttgtccatctggtcgaacgtagagaacaactgagcttggtcaggatacagagcagcaaaacttgaagggtcctgagtgtaggcacgacgaagagattcgaagcgttgcatcttgtctgggtcgtactgcccacggatgaccgcagcttgccactcaccagcagcgtcctgagtcagcgtctggaaggcattacggaacggaccattgttagtgtcagcccttaacaatgccaccttctgcgcgtctttagcagcctcagggatgtccatctggtcaatctgctgtagcttggcagacgcatagttgttcatgtcagaacgcttgaactctcctgtggcttcagagacaggaaggtcctcatagttggtagacacgttgtccccagccagacgccgctgataaacttggtcaatgaccagttgcttgttctgggtctggattaacttcgtgttctccttcgcctgttcagcagacttacgctttaccgcttccagtagtgtggcttcggcgttaataagcatctgacgctgaggagtgagttcttcaccgggctgaagctggttgttctgctccttgagtttttgaatctgggccagaccgatggttgggtcatcctgaagaatcgcagactgaacgcctaacgccaagtcttcctgatacttagccaccagtttatactcagtgccctgtgcctcaacaatagcagcgttgaagacatcaggtcctacaatctcttcgactgtagcatccacaccgttaagggtgattcgctcgcctcgtacttgctgtaggaagtttgagccaccagacttctggattgcgtcacggaccgtctgggtaatgacctctcgtgctcgctggtccgaagggatagcagcagtcgttagtccatcccgaaggtaggccatgaaggtctttccagactcaggcgaacgcatcaggtccccatcgttaaggaacgagttcatctcaatacgagtattcaacattgctgtctcttcagactgcttactgaaatacttattgaaggacccatagatagcgatgtttcggtctgtgatgttatcgttgaatccgcgctggaagaattcgtcggtagggttaatacccgcctcttcagcataggacttagcggcgtcctgaagtcgctggtggcgatactcttccatgtcctgacgtgtacggaactcaccgttctgaatcttaacgttaatctcgtcatccaccgcaaaggcagcgttacggcccgtcttgactcgaagtgcttccatagcgtaagggtcatcctgatacagcaacgtaccgttctggatagcctcacgtctctgctgaggtgtcaacttacggataatctcgttagaccgctcgtcagctctggtcttctcctcgtccttgaactgcttgtacaatccagtccaagactcaacgaagttggttagcgcacgagccagaccggagtcaccagtcggagcctgaacgttggctgcttgatagttgacggcgatagttttacccggcgctctgccacgacccatagtccgattagccagagctgattcaatattactagccattagtcctcctcttagctatgacctgtaggtgtgcctttagcagcactaatcggtgcggcaccaccggagcttgatgccccggatattgacttgccagcagcgtacccttgcatcccggcgttagcaacattaagtgcatgagctagtgggctggtcttgatgattttaccttgaccacggatagcagacttggtgttctcaatgttggcgatacggttcccgaagatagccgcatagtcacggttgtagctttcggtaatcccggctctctccttgactgtgtctcccgcgacctgacgttcaatcctgtccatagagttaccttccagaccggactcggctaccgcagctcggaccataccctgattgcggataccgtttaacgtggtctctgtcagttcagccatctgctgctccttcaggtctcgctcctgcatcttcaggttggcgtcagagtagttcatctgcttaaccatctcctgagcctgacggttctgagcgtcgatagcagcaccctcagctttggcctgactagaagcggacatagcggcaccagctacagccataatacccatgccgatacttactggctcgcacatacgtcctccttagagatagtgaatagttgaaaacgctcaccagttactgggcttacagtccaatcatcatggaatttagcgccaagcaacttcaagaatttaatgtgagacttattgcctgaccacacgtagttccagatggtcccgtattggtctaacattaagtccctgtactcagagatacgctttatgaactctcgcttctctttaggtctcagcttatagaccagaccggaagtcaagaaccatacgttatccccttggtttccaccataggcaaacacttcacctacaccgttcgttaaaaccacagatgatggagataggtgcttaagcagtctctcagagagaccaacggttgacccgtagtttgctttgcattcattaacatcatctgctgaaagatgccacagaaagtagtggacatctggttccgtagccttgcgaatatacataaagtctccttataaccttaagggcctatagtccctatagtgatagttaaggtaaatctataggcccttcaataagttagacggaacgagctttcttagcgtatgacgcctcccagccacacccaacgattgacactggggtaggatagtcggactctaaggttagactcgtggttaatgcgttaccattcatagcgaagcgatactgaccatccccaatgttggtagtcccgatggtttgctgaccaagggtgtacccgttgaaggtattcacgaactcccgctcaccatttctgacaatgagtctcagagcgccagtgtctttgtagttgacccaagcccgacgaagctgtagacgtccagtgtcttcagactgagtgccactctcgtcttcaatcttaatcaggaaccgtgagaacttgtaggacatcagataaggccgtccgatgaacactgtacgtcctgaccaatcgccattgagtacagccacagttgagatatcggtcaattcaccaaggtccacgtaggcaccctgactgtcaatcagatagtacctaccgggagacggagcgtttccaccataagcagaaccaatgtcaaccgtagtcttataggtgtcagcgttgtatgagccaattggtattaccatagacaccttggagtcaacgtggagtctatatggctctaacggaaagtcagttgcctccttgatgaacttaaggtgctcaaggtccacgccaccttggtgctgatgaacaatgaacatggtagagccaatcgacgcagacgccagaatcttatcagctttagggaactcccagtgcgaccaagaggcttgaagctgtacgccgtccttaaacaagaacttgtagaggtagattcggttgtatgcacctgtagagttgacgcagatgtagttctcagtccctgttccctgaatgtcaaacaccccgttagggatataggacagtacgtgaccagtggtatcatcggcatccttcacgtcagacacatctgctacagcgaagtatcgcttaatgctggtgaatgacccacgaggtgctgagaagaagactgagcgtcctacagcgaacggtcgggcattatctcctaaggcaaactctgagcctacatcaagctggatagacttcgaggtaaggacccccgagcttgtcatcacgaactgcacctcatctgaccaaagtaatagctgctcactaaacggaacggcatacttaaggattgagattctagggtgacttacagctacgtcaataggatcatcatcactcagtgtcgccgcactcttagggaagaacgcaaagtagctggctgaacggctcatgattacgttctctcctgacaagaaccctagcctgttcctgtagaagaacacatcgttaatcgtagcatccacgaagctaggcatagggtttgtgtcatcattaccagcaccacgcttagaccagtccagagtcttgaactcaaaggagccgtcagattgtcgcaccagagcatgtggcattgtggtgttatcgaacccagtgaccactcccggctctactgtctccttccacgtcttagtattggagtcatacatcacgtaatattcatcggcgctactgttggtctcaccttgaatcttaatgatgtacccatttggagccgcaaggggcaacttagagattgtttgcaccgtgtcgaggactgggctgattagctggttaacgtaaccatcctccgtctccactgagttaatgtcagtccctgaaggggcagtgattagcaggaagccagacccaaggtcgaacgtgaaggtagggtaagcagcaacgagaaggtctctaagagctgcaccgatagcctgagcatcaaccttaggtgggtcattctcggcatcattacctgctggcaacttatgctcaaccttaacgcctccgttgattcctaccttaagtgtgcgaccatactgtccaccgcgcaggttaattaaagcacgagctttacgattataaccagagtgtgacttctcgcttccacctttaacaacaaccttacggttaacgacgaacgtatagtctgcaacggtaacgacacggatgtcatctcgcgggttggacgacttaacgtaatctaccgccccggaaactaagtattgattaccactcaagtcaactacctgaatgttggacccgttgaacacgatgtaatactgctcctgctcatcacggttaatcaggtggaacttagggttactcccaacgtcgatgctaagacgtcgcttgaagactgtaggtggacgcttctggagtccatcactttctgatgaccagcagttaacttgcgcctcgccttggtctgagaacctcagtatgtctggctgctggctaataccacctttaaggttcttgattgattgagtaattagtggcataggccctccttaaatcatactcattaggacgtatccctcagcgatgtcaccaacgtcagcaatgtggacaaccttacgcgctacctgttgtccagtatacccgttgtcccactcattcaggataagccaatcgccaaccttaaagtcccggtcgttaagtctcagctctgctgtctttagacctagttgtaccggaccaaagtgctggcggtgaatcttcaggttgtgactagccattagtccctcccgatgtcagacatcatgttgtagcgaccagtgtccatctcgtactccataacctgctgatagagttctgcttcctgctcacgaaggtatagctctgactctggactaccgaagaacttagcgttgaactcacggctagctttagtgacgatgtagtccctgaagaccacaggcatctctgagaacggcttcatctccacaagctctaccgtgatagggtcggtgaaagtggttgactgagtggacaggtcgtacaggtatccacccatgttgctgtagtagctggtggccccagcggtcattacgcgaaggtatgacggcaagaatcgaatcctattgtcttggacatcaggtgtcaggacagcagcttcgttgatgttaaagttccatcctttagcttggacctgacgattgactcgatgcaggattcgctgagcgttcgagacgtctgcgttcccttcgtcaagctgtaggactgctggttcaccgatagcagctaacatatcgttgatggcatctaagtcatcgttagcattcagtggaatgtattgagccataggtttactccttaacggtcatatgggctagacggtgagctgggcagcaggtacgcccagaataagacgaatagtactaaccctgtgtaaataaggaacatagtccatccttaagcaaaaaacccctcaagcacccgaaggcacccaaggggtttcaattagtttgtgaaagatacgttgaaggaacgcacaggcgaaccgtcatacccaacaatcaccagaccttccacgccagaggtggccttgaagtagagactgttggttctacgggagtagctaacaccatcaggcgtagtcacctcaagaagcgaccaatcggtcacatctgaaagctcagggaagtcaaccttcaagctggttcccaccgtagaactgtatgtctctaaggtaggaccctcggtagagagggccttaaaggtcgttaacccgctgacgctgctgtgaaaaccagtgcgcctgctgcttctggacgcagaccaccgtgacccatagcgtacttaccaacaatcaggtcgccctgagcatcgacgtcgcggtcacgttccagcgccaagtcgcgcagcttaacagtaccgacagcagaacggtgagagaacaggcccacaacgttgtccagggcaactttaacatcaccagtagcagtagccgggaatgcgtgcttctgaccggaagcgatagtgatgccgtcatcaccacgagtttcaccagcaccaccctgagtcaagtgtggaacttcaacaaccacgaagcccattacgttacggatgttaccagtctctggatcaatcagtgcagcatagttagcagcgttaggcatcagagcagccagaatcgcggagtagttgtcaggcgtagtatagaagtagcggtcgccagcaggcacgtagttggcagtcagcttagcacgtgcgatggtcagttgaccaatgatcgcttcacccagcttggctggagtgttcaggtcggctttagtaccaacttccagaacggacgccttgcccagtccagcgatgttctcgtcagatgcggccgggaggttacacagaatcgccatctcagccagtaccgcaccatcggcagcgatagccagagcttcacccaactggttggaatactcaccagccacgtcatagtggttcatcgcgtcttcaatatcgaaaatcatcacatcggcagtcagcagaccatcaatggtaatcactttctcggtatgtttgatacctttacgcttatcggacagtcgctcacccggagcaagatacacaccagaggtgcgacccattactgggaactgagcagacttaccgttctgaatggtacggacaatatgcttgtcagctgttacagagcggcgagtgaatgcagtcaggacttcaccagcaaagaccttcaggaacaacgccagagcgtcggaaccagacttgcctttaccttggtctgtaccaactttctgaccaggaacgtttgccatatgataattctcctattcaattgaaagataaagtatattacttactgtacgcccaatccgtatggactgaagtaataggggaaaccttgagtcgtctcttggtctccctatagtgatagtttagtcctacaggcttgaggaagctaccttagcgcgaacttccatcgtgtacttagcgtcacgcaggtagcgcgggtcactcatggccttaatcatgtcagcctttgagctgaatgcttcggtctgaggagccttaggtgcgaccacaggtttagcctgagtggtgatggtacgctgaggtttaacaccaacagctttacccagagtcttgccagccagattcagcagagctttggtagtcgcaatgtccttacgaacgatagcagcttccagtgcttcacgagttgacgggtcgttggactcaaggtgtgacaggatgcggttaaactgttcagcaccaccagcgtagcgaactactccagcagcatactgttcagccagagcttcctgaccacggacaaacgaatctacgaaacgcttggtgtaacctacttcctgcaacttagcgtaggatgcgtcagacagcttaccgtccttggcgtattcagccttgatagcggtaatttcatcagcagtgaccttgccagcttccacagcagaagacaccatgtcgtcgaatgcagcttcgttttcatccagagcggtgacactttcggtcagctctttcggtgcatcaccaagttcgatgaactcaggctgctcaccatcggtctctgactcttcgtcatcggactcgtggtcttcttcaccttcagtctcttctacgttctcgtcttcttcggtcgcttcttcgttttcggcttccagttgcttgaaggtaatagcgtcgtcgccatcacgaacagctacgtcctgttcaagcatagacttctggtgttcgttcaggtcctcaacggaaccagtgattgcattagagctaacgccaaactcggcataaactgattgagacattgagtcattctcctttaagtcgttaatagttaaacacctacttgcagtgtgggactaacggctaccatatggttggcttagtcgctcttactttcggtgttcctatagtgatagtttaggcttgagccatgtcctcaccagctcccttacctacagcagcgcccatgttagcaccagcagcagatgcaccgttggccacagctccttgagcggattgttcagccatacgttgcaacttctcatcctgggtcagcagcaagccagcagtgtcaatacctaaggcattcagcagtcgcagcttcagggttggcaagttaatgtctgggtcctgttgcagaggctgtagcccggtcatcatgttgactgcctgagttagcttctctaagtcctgaccacggcccagagcttccagaccagtggagacagtaggttctaccgcttctttcggaaggtcaggaatcatgccagcagactgaagctggttcatcagcacacggacgataggtaactgaagctcttgtgattgtactgagtacacgccacctaaggtcgcctccagttctccagcaacataacgaatctcttcagcagtgacccgctcggcattacgctgaacagcactattaagaaggaaggcccatcctaaacgttgctcgatagcgtcagccaccgacttggcaatcgtaaagtcctgacctttcgtcagttgcaggaagttgatgtcctcaacgcgaccagccacgaactcacctgtagccgccttgttcaggcgtcgaggttgcgtgatgccgttcgggttaacgaggcccaccaccttggaggctaccttagccattttggtgatagcttctgtgatcgtctcaagtgagttcagatctcccagatactcctcgcagtaagaacgaccatagtcttcaccatccagtcgaaccattcgtaccgggatgtatggacatgcagtcagcgggtaggaaccatcggtccctgctacctctatgccttccacttcctcgtagcgtagatactcgtcgtcctgacggtagatgtgcgtatacacttccagctctgtgtcaggctcatagtcgtctgcgttgagttgagacttcacgtcttccggtagagcactaaacgctaccttgtcgagagtcacaatctgcaagatgttaccgaacgcatcacgttgcacaacgtaagacactaagcggtacattcgcataggactgtaggttccctgttcaggctctggaatgtagagcagacagttaccggagacgataagctgcttcagcgcctcgaataatggaacacggaaactgttagtctccatgtaggccatcaacacacgctctaccatagccagcccttcgtcaacacgagcagccgcctctgagtcctgactcaaggtctttgcctcatattcggagactgtcagtcgcatccacggtgactgagggaataatgccaacatcagctttgcagctaagttgttcaagcagcgagcacctacagcttgccacggagttgtgtactctgtagacgagttgtctgactccttaggaaacagtgacgggatagtgacagcagcacagttctgagcgcgtgtctcatatggctgtcgtccgttcttcagtctatcataaaccgccttcgcgccttcggcagcaaagccttcacgttcagccattcgtcacctccttaaatagaaataccgccaccagaggtgcgagatacctgaaggctacgcttaccggaacgcttcactttcttctcgtcagatgcggttgcttcagtatccacatcctccacttggtcgttcggtacttccactggtgctgctggggtctgagcctcaacaaccttaggcgcatcgtccttacctagaccaacggtccccaacgcattgttcaccactttcttgaaagccttactgattgatttacccacggttaatctccttagttgttacgatgtctaccgaaccggaaacatgcttgacacgagaataccagtcaagaccccaacgcttgcactcttcgtctatgatgtgcctgacagtctcaagaaccttgcgggaggactgcgagtcacgacgaatagcgacgattgaaaggtcaagaccgggggtcggtcgatgccaagatgtggtagccagcatgtagagatacgctactggttgacctgagacatcgtagattgtgtactcttcaccttcgaactcgtcagccatacggtaggtatgagccttgaagtcctcgaatgacttgaagttagactgcccgtcttcccataggcgacaagcgcacatgtggcgaccttcgcgtgagttgagatatggtagcattgtcttaccccatgttgacgccagaggctcgcatagcgcgactaactgacgatttatctttaggcgcagactccttcttaaccttaaggtctttgatacctttggtctcattggtgtccacatccgattcagccccgatgtcaactgacgcaacttcctcactcagaggtgctggttcaggtgcttggaccgaaggcttcggagtgctaatctttggactgaaacacatagtccctcctacagttaatcgaactgaacggtatctttcagctcacgacgcatagcaatcgcagagtcgagagtgtcagaacaatactggagacccttgatgaatccggcaatgaacgcatcgctgtagccttgctgcttgaggagactgatagctccagtcttctcagcgtagcttgcgttgaacagtacgtgcatgaactggacggcagactgggagatgttcgggacatcaagtctttcttcctgtaactgcttaacaacgttttcaatagcattaatcgccatcttgaatctcctctttaagttaagactaaagtctatcttatagtcatatcttaggtcctaaagtccctatagtgatagtttagtatttcacctatggatgactgttggattgataggatatgactatcggttagactcagtgtttagggcggttgttcgacccgaaccacttgtacatgcagtaaagggccagaagtccgacccagtaaattacatggatggtgtccacaggatgacctccttggacttagggtcgtagtcggaggcccgacaaatacgagcgacctgagcttggaccagaagctcctcctctgtcatcccagctttagcagccagagtcaccatgcagtcccacaacgtcatgtcttcacgcttcggatacttcttccactcagtcttaatctggcctttgttcttaccagtcttaagctcacggctctcctgcacgaagtagtacggctcgtcaaggaacgcacgagtggtgtcctcacccatccccggaataccaccgtagccatctgtagtgtcacccttgatggtttgctccatgtgccagtagtctgcctcggcagtcgtatgactcagtatttcaccagttgttaaccagaagaactcacagttcgggatggtcttgaagtccttatcgcaggataccagaaccgcatggtcacaacctacaatctgaggtcgtgtcccgatgatacccatacagtcatcaccctcaagagtaggacgaaggaagctgttgaaccgtgggtcagccatcacttcggctacgaacttcttgtaacctacaggcttgcgagaacctttacggttggccttataggtaggcagaacatccttacgccagttgttatcgtcagtaaagcacatcacaatcttagcgtctttccacgccttgcgcttcttaacgatttcagcgatggtgttatcaaggatacgacgagccttctcatggtcgcagataagggtccagatgtcatcgccccagtctgtctcgtcctcggcagcagccatagaagagaagaccagatagtcaccatcaagaaccagagctatcttcttttcgctcacaggcagcctccgtgttggttcaggaacttggtgccagcagcggtaatctcccacgcaccgttgttacgcccatccatagacaggcagcttagatgtccacgactcgcagcctcagccacaagtgcagcgttgttgcgcacatagttggactggaaggtcttagggcaggacttaagggccgctaggacccgtaagtattcactcattgctttacctcgaatcgcaggttggacacaccggacttgccatcaccaaaggcgtctaccagctcttccttgatgttcttcttggcgacaatttcaagggcagactcagggcctgactcgattgctgctttgaccagagccaactgaagcccatccaacttctcaccatcagcgtaggctttagtcatctcagccagttggcgacacatggtctcttcttcttttgagttgacaaccatcttcaggtcaaaactcacacgaatacgtttagtaatagccattagtgttactcctgtttaaattgtccgtacttcttgtcagacgttaagtttatacacatagaggtcttgactctaacctcttcagtgaacggtataagccagagcaaatcctgatagacaaccgctagtaggtagatgtctccaggactgtaagttggcttaccgcatcctcccagtcttacctgtatgctattacagttcttaaacttcgttccggtcttgacatgaaccctcgtaagggtcccgtctatatcgaccaccaagtcagcctttgactgcgtgaatgctgggaggaatacttgatgccctttggctgtcagcctatagcttacatatagctcattagcagcaccagtgaagtgctgggactttccgtcaatgacattctttccacgttggtccaatcttaccctccgtatcaagctcacacttgaagttataaaaacgtcctacctcacgcattgcttcttgtgcaatacggacgacttcttcggcaatctcctgagtacgacacgcaatctgcaattcgtcgtgaatccaagccattatcgcaaagtcaccatcccagccattaccatagccagcttcctcaagtttcttctccgtcagcaccatccagtgcttacatactacagcaccatcaccttgaagtaatgcgttcagtgctgagtgtggcgaccggatgtggatacggcgaccatcaagtccacgcaaccaacggcgtttccacttaacgatattctctccgtccacccacttagattctgagattaacgtattactcacagcttccctgaggtctttgatggctggtgtaccctcaatgaatttcttcatgagagctgaaccttccttcttaccaccgccgactatcagtccaatcttagcggcccctgcaccatacaggaacgcatagatgaacgtcttagcgttgttacggaaagcctcatggtcgtggttagacttatcgcgtgggacgttaggtgctaacccagcgtttactgcgttggcccagtggatgtcaccttcgaccacagtcttcgcataggcaccaccatcaaacggagccgcccggttcccaagacaacgaagctcaagacctgaagcatccacgcctacttgaatccaagggtctggcttgccatccttcttgttccacgctgcaccgaaagcaccacggcaagtctcaccatacggtgcaccgttagccgggacctgagccatgtttggtgaactatgggtcgcacgtccggttactgcaccacaagggttgattgaaccgtgcatacgtccgtctgggcctacaagtttcaaccaagcgttcttaccttcagcagcctgacctatgcgcttctggactaccagatactcacggaccagttctacgcaagcctgagcctctgcgtctggtaacttaacgtgttctaacgtctcgtcatcgactacaggtttcccggtgtcagtgaagtcaacaggctcccagccacgctccatcaggactttcgctaagtggtctccgcttcccggattaaactcaacgtaagtgattggcgtgaatggtgctccttccatcgtgtctcgcgtatcgcgttcacaaggttcaagacctaagcgttgagctttgttcttcggcttcttaaagatgccaccgaccttaggatacacgaccctcggatacttcggaaggtccttacctgtccgtggatgcctgaagaactccttgcctccctttggtgcgtaccagctaccgaaagtcgaacgaagcttgtccagcaactctgcacgtttgacagtgagttcacgatataagccttcgaccatctcggtgttcatcggatagccgttacgctccatcttcgcacaggtccacgcagcatcatgttccagacgcaacgcataaatctgttcgaaagcgaactgttcagactggaagtaatacttgtcagtcaggaacttcttgaacaacgccagtgtgaccacaacgtcttgaacgttatagtccagcatctcctgagacgggaacaaccattcgtccccagccttatattcgatacctccagccttgcacttggcaacgtaatcgtgtttgtactcacccttcatctcaccgagacgatagccccaagcctcaagagactgacggcccatcatattaggtggcagacggccagctttcacagcgcccatgtctgagaacttaatgttgggatacatcaagcggcccaacaccaaggtatcaatcatcttgtgtttcgggaagttaaagcgtttcccgaagtacagacgcttcagcttgtcaatagccgggacgtcatagttgataccgttatggaagacaagcataccagtaggcgttgcagcaatctcttccaccttctgtacatactctttgaagccaccgatgataccgaccatcggcgctaccccatacttaagggtctcattcgactcggcattaatcaggaccccacaatggaactgtgacacggtgtcaaggagaccgtttgtctcgatgtccgaaccccaaatatccttaaggtcaaacatggttaatcctccgctttagtctaatcataaaggccactcgatgtgaatgaccttgagtctagacctagaagtctgtacgcaagaagtgatacataaacttccggttagctctcttccacgccgcagagttgaaccgctggtctcccagaatgttcgacaggcaggttgcttcatcgctccaccatttatacatgaaccgatggtagcgggctttaagtttctttaacactaacggtcctccataaaattcttatagtcagcgatgtcccgactagaagtcttggttttcccacgagccgctatcatcttctccgctgctgccagtgaagctaatcggttcaagccaccctgtcgttttgttgtattcaaggtgtccagccactccagtatcacctgtaaagcgacacttgagtagacgaagctgaacaatgttaggagtatcaccttgctggttacgttcaagtgcgatgatagtatcagatagttggcgtagagcaccagagccacgcaggtcagtgattgaaacaggtcggccttcttcatgtgatttacctttctctgggttcttcaggtgacatattaccactacaaccacacccttcgtcttcgcaaacttcttgagacgagtcatgatgcggtcaatggtcttacgttcatccgagttatcttccatgccagacaccactattgagatgtggtccagcagtatgacgtcacagtcaagaccgtccaccatgtaggataacttagcgaacaaggtgtcttcttctgactctgcaaatgaatcgtacaggtggaacttatcgtccccaaacagcttgtcataccattcgtcgaaccgtccatcctctaagatggcttgcttcagttccttgctctgacgtagacggacgttattgtccagacccataaggtcctgaactgtttcctctacagcctcttcgagcatagccatgccaacacgcttaccgcgtctgccccactctaagaggagctgacggacgaaggtagacttacccatgcctgaccccgaagtaaccatgacaagctcaccagctcgcgcacctagtgtcatcgcgttgagtgttgtgcatgacgagaacatgagaccttcagtctctgccttaagcattgcctctcgtgtgcggtccttcagacttgccgctgataccacgccagccgggacgaaaggtttagcgttccagattgcatcggtgatggacttgaagtcctttgcctgaagtgcagcgtttgcgtctttgtacccgttgatgaacgctaccttgaccctacctgctggtaagactggagctgcatcctcaatggcctcacgtcccggctcgtccatgtcgaacatcaggataatctcttcgaactggtcgagatactcaaggttcgctgccagtgtcttcttcgcagacttcgcgcctaacgggagagagaccacaggatacttaccgtcctgcacctgagctaccgacaggcagtcaatctcgccttcggttatgacaatcttcttgccgccggaccagagctgagagccgaacagcaggtcgttcttcacgctaccgatggctgtgaagttcttgtctgcgtcacgaaccttctgccctaccttggtccctgacctgtcgtaataatcagcgacctgaaccatcttgccacccatgttacccacccagtagctgtacttcttgcatatctccatgcttaggctacgggctggtagtgggacatatcgtccatcgttctcaccgaacgttaacagattgctcacttgctttctacctcctgagggtgtgtatccctcggtcaactccatgtctcctttcttccatgcgactgaagggtcacatgcaaaacaaaattgatggccgtctgagtaaacaccattggcatccgaggacccacagtctggacactgggtgtgatacagaaagacactctcgtcgtcttggtcatcgtatggcattggtcactccttagtcaataatgcgaacaaagggacaagactcgtggtctcatccctaaggtgatagtttagctgaagaagcctttcagttgcgaggcctttgcctccagacgtttagcttcccagcttgcgtcctgagatgccagttgcgcagcctgcgacttagccgccagttcctcagcaagtttcgcctccacgctggcgacttttcgttccacgctcgcagcacgagcatagccacgcacaaccagacgacccagaaattcaataaacttaatcatgttaatgctccttgttagcctcggtcggaagtgaccagttcgttagtgttcagccagcgctgcaagtcaaagcttgggcaagcctttggtgctacatcgtggtgagccttgatgtctgcctgagggtacagtgccgtcagttcagccagcttgtctcgtagagcgctcatctgagcaggcgtgaagttggcttcaaacttgcccttggagtcaatcccacctacaaggcatacgcctacagaccgtgagttccagtccttaacgtgtgaccctacgacatttaccgggcgaccctcttccacagtgccatcacgcttgatgataaagtggtagcctacgtcaagccagccctgctgcttgtgccacatgcggatggtctctaccccgatgtccatctctggcttggtagccgaacagtgcacgaagatagcgtcagtccgggcccgtgggttgaattgcaccttacttaccattgtacaccaccagctctactacgaccagattcagatgtgactggaagcgctgtgtgtcagtcgtgtgcatctggagcaacttatggttgaagacgtgagagttgctaatcttcacgtacacttcgtcaggcttaccgtggacgatgaacgtatgacctacaccaatcttgttgatggtcaggacttcacgcttcacagtcacaggaggtacgctcgaagctggcaggacttggggtttatcctctacgatttcctcaagatcttcttttaaaacccacgccccccacataccgtcaggctgagtgctataacctgctgctccgtgtttataggcgccacgctcagtggattccaccagaacaagtccaaattttggtgcaaggtctttcgcacatttcgtaacgatagtacctttaggccacccgtagccactaaccttaagtctatatttctgagtcatcacttaactcctttcttcttggggatgaggatacctgaaggcagacgtacagccgcctctcgcagccactcaaccgggatgaacttatcggcatacttatagccgttcttttcgcaccatgcgccatacgtggtcggagaccctttgtatagcttggagcgggaacttgagaacacgaaccggatgtctaactctgggtgctgttctcgtaccagaaggtgcttcttacggtcatcactatcgaagatacctttggtctccacgatgataccgttaggaaggataaagtctggtgtgtacttgtggtcggaagccggaatcacatagttgatataatggctttcatactccgctttgacgccgttctgttccagccactgctggttcttggcttcaagtccagagcggtaggcacccacagagtgcccccgttttgcagaccattgggccattagaagtcgtaatcgccaccagagcctgagtcgtcaccaccttcagaaccatcgtcaccgaagtcatcagacccgaagtcaccatcggttgatgctttgtatccagtaccgaggtcttcatcatcaccccagccaccatcgccaccagcaccatcgcctttccactccttcagttctaccagaaggcaggactcaagctggagcttaacgcttgcaccagtcgcagcgttccacttaaacggcaggactttaaacttgaccttcagcttagacccagagccaatattcgggacgtcacggatgagtttagcatcggtgtcgtagaaccgtaatacgataggctcggacttgccgtctttaaggtaagacgcaaagcatttaaacttaagggtaacagtaccatcaccattctcaatccacggcatgtcgccttcacgcggctcgataggcttcttgccacgctgaacctgaggcgggttcttctcgtggtctgcgagtgctttcgcatacgcatcgtcgtgaatcttctgtaagacatcaatcatcttacggaccttcgggtcatccagactgaaagtcaggttaaccttatgctcaccacgctcattaaacttggtgtctgctttgttcagccatgcgtaaggctcaacgataccagctaccggagtggtgaaagtcttcagttgctctttagccatcggtgtaaatctcctaatttaaagttacgaactggacgtctgtcctacagtgatagtttaggcctcagggcgaatccgtccgaccacaaacccagcgtcctcatactcttgggacttcagggtagcctcttcaagagactttgcgtacaccggaacctcgaaggactgaacgcgaccctcaagctcaacgatgtatttcttctctacgtcagtcatagaccacgctccttccataagttgtaaagctgaaggtaatcgacgttacctgtctcctcaaatttacgctcgcaccactcactcggcttttccatattacacctctatggcccaatatattaaaatgattagtgctccaactccggcgcatactacacagtaatgcacaatatcattaagcatggcacttacctttgtgcaggtcgaacagctcctgatagaagtccgctttgttcaggtccttctccatagtagccagctcggacttcttaccagctcggagtcgatacttcaggacgttacccatgcagaaaccacggaactcgctgatagtcatggaccgggcgataatctcaatggactccacaccgtcaaagacctgatagtgggagggcttgcgcacaccatcgtcagtgactgctggcttgatggactcacggagtttgcctaaagtcatctctccgtcgtcattatcatttaatggacatccactacagtctacgccgaggcatgatgtatcctgacaggtgttatgggaatctggtttattggtgttctgttccaccagtttaactactatctgctcatgcttagtcatttaccacctccttcacgaactcaacaaacagacgaactcgaggccacttggtgtagaccacagatacgctggtctcacgcttctggcgagcctcttcagctttgcccggagtaatcagcgcgaagactgtaggtgataacttaactgccttcccgaagtatccgagcttctcgttgcgcttaatgcaagcgaacgggttgttggacaggtggaaggtattggaataacggttgaacattaagttcttagacatagagtctccttaggttgttgatggttgtcctatagtgatagcttagggtctagctggtggcccagacgcaaagaaacccagcagtccgcgaagaccactgggttgacgttaacgcatcttaaagttgttcaccttagcagccttacggtagcgatgactcatggttgatattgtctcttcatcgtagtaggacttggcccacttcttgagtttacgataccacagctcgccatttaccacagcgtagagttgaccacttgctatgttgatataaagttgtgtactcatgacttcaccgttgggttgtcttcggttccacgccagcacttgaagctagggtgacgcaatgagccatcagggaatcgctccataaagaggacttcaacctgccagccttcgtatggattaacctcttcgtcttcctgacgttttacctcagccgtgaactcagccttctgctcctcagtcaggccgcaagcgttaaccaccatgccatcttccagtagtacctcaaagccgatgaccttaccttcgttagccttacccggagtcccccacacgagtccacacacggtcccgtcgatggtctcctcaggcttcattttccacatgccagacttcttgccacgcttgtacttacccagtgggtccttgactaccagaccctcatgtccttccagacgcttctgttcgtacagggagttgagcgactcaaggtcatagaccgtgtgtgactcagacagaacccagtcgatttccgggaagtatttctggaggagagggacgatagcttcggccttcaggcgtgtgacgctatggataggaccttcggctttcgggtcagcaatggttgtcatatcgatgacaccgtagaccacaacctgaagtcgtgacctggcgacccagaacgggaccttcttaccacgccaaggataacattcagcgaactcttcgttgctaggcttcagccacttcgttcgaattagacctgaggaggtgttgaagtccacacctttgaccatgacctcgccgtcaatcatcaagcccacaccttcgtagccagcttgacgtaggaaccatcgccagtcagcttgtgtccacgcattccctaactcagagttcatccactccaaggctggaagaggtttagactcacggctcagccagtaggtctcaccttcacgcaggaccgggagattcaggcgcacaccatcgtacttcacttcagcttccagagacccggctgcttccagtgccttcttaatgccagactcagagtaatctacagcgcggtgcgggttggttttaatagttgtcattatgctttgctccatgtgtcgagttggtcagcgagaccgttgaggtagtcggttgcagtattatacagcacgtcttcatcgtagtgtgcgaaggactcaagcgcgaagatgttaccggctcggtcctccaccctgagtttcatgcactcttggcgtgacacatggtcttgaaactcctgagatataacagcgaagtctaactgataaagcctgtaacacgctgctctgaaagcgtttaggtttccactataaagtcggcccatttggttatgctcctacgaagtatttttcttggttgaccagagagtctttaccttcagcattacggaaagcgcccttgataccgcctccacgcttggtcttgttcagcttgcggcccttaggaatgtaaccttcagtctgctggcgttcacggatgcgctcaaagttgatagtgttctggtacatggtgtagctcctgattgaatgagttagggttaatcatgaaggccacgactttgagtcatgaccttgagtctaatcctatagtgatagtttagggttaacctcttctgcgttggattaaagtgaatactgctagtgctcccagccacaaggccagcaactgtaggtctgtcatttggtagcctcctctttaagagcttgctcgtgtgtctgcttaaccagcttaaccagccacttgaatgttacgttaagccgctttgacagctctgtagggatgattgtggtcttcaccagacccttaccattgtgctctgttactgtcacgatttgagtcccacccttaacgccagtctgcttgtgtgcaaatttcatactctctcctcttaagcgaatgcaaagtctgaagacaagatgtcttctatattcagtttacctttcttcggaagctcaggcaacttgtcgcgctggctctcatgaagctggtattcaaactgctcgtagaagtcaagcagcacatcgttgtcgcggtaggtctcgaccatcgtctcacggacaccacggaacagatactcagcgtcagccgggatggtcccaaagctatcatgaatcactgcgaatgacatcacgccgtacttgcggtgagtgtggactacagtcttgcgtaggtggctaccatcttgtgagtggacgaagttcgggctaatgcctgactcctgcttgtgcttgtccagctctttcttcgtgcctttgttgacggtaggctgaaggttgaatgaccctaagaacatcaggttcagacgagtggtatccttcttgcggtattcctgccagaccgggaacccatcaggtgtgacccagtgtaccggaaggcaaggcttcaggatttctccagtcttcttgtccttcacttcagccgccagcagcttggcagcaccttgaagccacttcatcgcgtcaaccgcagcaactacggtcacgctcacagcttcccaaatcatcttagccatgaagcgggacgcttggcttggttcggtgaacatagcgccagaccctgagtcaatcgctggcatcacgatgtcctcgtaaacttggtctgcgaagccatactctttcgacccgtaggccagagtcattactgagcgcttagtgaccttgcgtgacataccgtaggtcagccactggcgggccagctctcgtgtccccagcttgagacgttcggtaatctcaccagttttcttgtcctcgtgagttaccatctcgttatccgtgccgttaaccaacaggactttaagctcctcctcaatgcggtcagacacgatgcggtagatgtcttggaccttaccggatggcgttaggtttactgcatgtccaccgatgtggtcacgaagcatagcgctgaagtgctgaatcccagagcaggacccatcgaaagctatcggcagcgagcaggagtaagacaatccgtggtgcatcacgccagcatactcgaagcagaacgcaaggaagcagaaaggagagtctaacttgccccaccactcaatgctatccatcggtgccttagcagcagccatgatgttgtcgtggttgtcttccacccacttgatgcgctcctcgaaggtgactttatcgacacccgcacagtttgcaccgtggaccttcagccatttgaaaccatcagcaccaataggcttaccgactgccagagtcaggagacccttttgcatgtcgttaccctgagggttgaacatcggcacagcgtagacgcgaccacgccagtccatgttatacgggaaccagatggccctgaactgagagaacttgttcgcttggttaacgataaagctcagcgacaatctgcgtgactgtctggccttctcgcggcgatagataccagcagccgctttcttccacgccttgagttcctcttcagtctcacccgcatagtcttcaggcttcagtggctccatctgagggatgtcgtcaataggcgtgttgttcaacttctcgaccatgttcaccacgtccagaaccttcttgttcactttccaaggcgtattctggatgatattcacagcgtcatagacttcaggcatgtacacgtcttcatagcgtgccaccgcagacttagaacctaagcgaatcaatggcaacggtctgcgacctttggcccagtaaccaccgcctacgacacccgtccacggcttaggtggaactacgcaaggctgatagactggcgcaatacccgcaaggctgaacccacgttgtgccatcttcttgacccagaagtctgacaggtggaccatctctacgtcagccgctgcattgccagcaccgtagcgcttaagctcgaccagttgtgttgactggatgacaatctcaagcatcttgattccaacgtggacagcctcggtcggactccaagtcccccacgcatcttccagttggccttgctccagcatggatgcctctaccgcttgcatgtaggctttcttgtaggatgccccagctcgcttgttcaagttctcagctatcgccttcttgaagtgctccttctccttgtcacgaatgcgaccgaatcggatttcatcctcaagtgtgcgacctatcgcggaggccatcggtgtaatcggtataccttcaggcttgaccagcttggagaggatgaccttcagtatgataaccgcagcagactcgcaagagatacgcagagagcggtccttgacggccttctcttcagtgctcaacatggtgaacgctacgctcggacgtgaggttgacagcttcccgtctggaccttcgtgccactccttgacggcttgcgcaatcttaggaaccagagtctgcatcaaaggcttggcgacctgattgtctgccagttccccgcgctcagtctgtcgctcaaggtttttgatgaaacgtcgctcgccttcagtgtatgcctcatgctcaagctgaagctgtttgactgcaaggtcttgcccgtagtggtcggccagcaggttaaacggctcaatggcgttcgacacatcagagaagtcgtgtttatcaatagagatgacgctcatacttaaagtccttgttattagtctttcacttaaagtctctttggtctttcacttggagtcttagaccttgagtcctatagtgatagttaagtcagaattacttgcatatcaatgggttagcgtgaagatgactgaagtcaccatgagtcgtgtgcttgatggttgaccgttggtctatcgccttccagcctgagactaaaagtttaccatcgtcagtgattggtcgtccaccatacgccagacacatcagttcggacttatggccctcagcccggagtcgtgcctgaagtacacggtctcgctcctgctgttgacgtgcggagtgacttgacgttccgtgacgatacccggtagccagtaggcttaacatttgcatgtctgcgtccatagagtgtaccagattaatcccgtatgacttgttcattgtagtttgctcccaagtgttgctatatcccagacgttcgctaagttgcgcatgaatcgtccgttaggttgacgtacagtccagcgacccagacgtacatagttgaatttgtagactttacgcgccttgttaatgtctctcaccagcacgtaggcgataagtccatagcctatggctatcaatagtgcaagactcatagtttatcccgccagtccaatccacatcaagataccgcgcacgacacctaccggagagaatataatgtccactgccagccagcccagtcgtaatgcgttaccatcagtgagcaccgcagtaagccaagatagaataatggttacgtaaagtgcgatgattgtaaatttcatagtaattctcctatcaatgtaagtggtaatctttgaggccacctatcagtcgtgacctctcgtttatcactcagcgtgcaagctgtcgtgaatacgctttcggccatcatagaccgccttcaggtgtcgcatagtcgcatcgtggtctaactgcccggtcttgaccataatccgggcgttggtgacgtggtgctggcagagaccataagttactatcactcgcagtcctcctcatcgtcgctctcttcagactcgaaccagactacatccgagctattagacacatcgttatacagtgcctcatagatgcgagcttgcagtatacgcgttacgtccttggtctcaggcatcagcccagagtcttcgaactcatggtcgataccatcagcagccattaccgtgaaaatctcgtggtaatagtgcggaaccttaccgtctacgacctcatgcagcgcatcgtggtaatcatcgccttcagctatttcgtcgtactgaatacgctcgttaaatgcttcaacggttgcagccagcagctcatagtatgcgttagcgttacgttccatagttatatcctctcaaagttgtttgtgtgtatgttagtgactatcagtcaggccgctatgattctaacgacctgtagttaatcactctctcagttagcgaaataaggagctgagacgcccgctgtaggactaacggttatctgcgagtctatcaggtaggtctcgttatctatacgcacagtatctacgctgtagttgctgaacggcttgcttgagaccttgcgcactaccacacggtgacgcgctcctgtcatctctttaagctgaatccacgcataacctttagtgttcacgaatacttcattgtgattagtgattgtgcttaagtgtttcatagtgtccatccgttaagttagtgactatcagtcagggccttcagatgtagactcaaagaccctgtagttagtcgctatcggtgcacattaagagtttatccatattgttaaagagcattcgcgttggctgtcgtcgccgtgctatcccgtttcagtgttgggactcaccgttgtttcgtgttgatgtggtacatactactttaagtctgtactgcttgtcaactactttctgtcatctgcctgttgttcgtatgacttatcaggctgtctacttaaccgtgatgacccggcgtcttcactatccggttgttgccgtgtcgtgttgacggaagctattaagccatagtctggacatatagtcaataggtaatttgaaataatattgattaagctatcgtcggccccatggtgtaagaggatatagtctttgactaacatgtcttagaccttaagtctatagccttgtgtctattaaccgtaggtctctgactgtaggtagcggcattaccgatggtcgatgactgtaggtagttagactgtaggtagtgactcaaggtctgatacagatagagactcaaagacagaccaatagtccctacctatcgtccttccctaagccataacctagacctatcgtcgacctaacgtcttgaccattggtccagccttatgatagactggggtagggcctttggtctggactgaaagagggcctatggggagacttgaggttctttaactgtgagatgtggtctcaaactttttgtccaaaactcatcgtccctccttaggaaccagctactgtaggtcaaggaccg

SEQ ID NO: 11 - DNA, 70861 bp, artificial sequence
  BP1168
tggtggggctacaccccttacaccataagcacccccccctgtctttactagtgtagccttagcctaccccaccttgtacacgttacacgttgcttcgcaacttatggacatgttgtccatatcttatcaatcaactattggagactaatactatgactactcaggctaacgttcgtatgactgtaggaactctgttgggtactgttaacgaagcagcaactactgtagctgatacattcggtactgctactaaagcagtaggtatgcttaatcgttatgtaactaaacaagcagataaacaaatcattcgtgacaaattagaaatgcatgagtttaccaataaacttattgaggaaactgcaatgcaagaagctattcgtcagaaacaaatcttagacttctgcaaagatgaacaaaacaaagaattgttctctaatgcctatgaccgtcttagcaaaatcttagcagactctaaataataacaaacaaatggaggctcctcggagtctccttttacatagaaccgatagttcaataactatctactttaaagataagaagctccgcttcttttggatgaagtaatgcatccaatcctgtatgaaatcttaaccttttgtctgggattacttaccgacaaagtagtctcaactaatcaaaatcaactatctggagagtacaaaatggctatcactacttttgctaaaacttttggtcaggcttctactaaaactgaatccaacaatggttctcgtccgaaagctcagttctggattaacgttggctatgtagctaatgaaggcactgaagatgaacgtttcatctctctacctactggtattccactggatactcaggaacatctgccaaccaattcctctaacgaagacttccgtgcaatgcgttgtgcacagaacgatttgttagatcaactgatggaatttgctaagactctggaaccaggtcaggacggggttatctcactgcaagttcaacttcgtcgagttaatgaagaagctcctgctatctcagcaagtgagaataaatatgctcgtaaactgactttctaatctctataggactaccttcgggtagtcctttttaattttaactatctaaatactaaagtagagattttgacccttttcgacgaagggatactaaaaagtaatggatagtttgagcagatgttttagaagaaggaatatacagatgcaccctcttataaaacggttcctgatggactatcaggagtggttagataatggagccagtgaacctcactacctgtttgataggggtagtgggctatgtgttcaactaggtaaatatcttagaagacagccaatcagtgaagaaacagtagatgctctgtgtaagagctttactcatttacttcctgataatgataccaatctaccattcaatgtagatgttctcgactacatgatggagtgttctgatggaagatgtcatctgaaccaaagtcgaattacttggattaagagtcagttggagagtaagtaaattatgtcatatgaaattgtaaaacattggacttctaaggctggtctgaaggcttgggtattgctggtaaatggtggtagtcatcattgtggttatgtggaaataccagaagcattactggataaaaacttctatgactatatctgtgatgatgaagaaacacttcatattgcagtacatggtggagttacctatcaaggtgtccctcagtggactgatgggattaaagtcataggttatgactgtgcccatgcaggggataaactgaaatgtcctaaacaattcattggctccattagggagaaactctatgaggattcttatggagtatggcgagatgaagaatactgcatcaatgaatgtgaaagcatggcagaccagttaattaacctgataccaaaattagggtttaacgatgaaattcagaacagtaatggttaatgctcttgataccagaggcaatgaaatcattagctataaagtgcaaggctttaaatggttcaaatggaaaacattaactagctttaaagaatttgagaaagataaagctattaagttaaccaagaaattgaaccaacgtaaaaagattaaattagttactgtaattaaataaggataaggcaatgcgtaaatcactaatcatggggactaaagaagacgttgctaagatgaaagctaaacgtcagatgaataaagcagtaacgtttgcagaacgttatagtacgtctgaaccagtacgtcgtattgttactttcaatcatccagctattaagggtatgtaatgcaaactaaagataagaaagacttagaacgtcttctccgtgtatatggtgattatgcattattagcagaaataactaatattatcgaagaagactgtcgtaagggttatgccaataacccacaagcaataattcatcgtgatgcagtagtgcttagagaagcagtcagtaagatgcaggcattacatccattaagacaacgagcataaataggagggggctactaagccctcttcttatttttatcgtggttattaagcaactatcttagaggaaggaataatggaacaattaaactacggttataagattaaacgcaatcaagtaagaggttcttggttatttatcatttatggtaagccaatctatgaattacatcgtggagagaaatccaagacctattacgtaactcatattgctacaggaaagactcctgcatgtgcaggattgcttcgtgatgcaattatgaaagcatgtatgttagaaggacttctatgaaccaaatcattgctatcccgcagcataaagctcgtattgctgacaggaatattcgtattcattatccaatgcctttgagcaatccatttcagaaaaatgagagaaccacggatgaagatatagcagcagcttatgaggcatatcttcgtaaccgtttggtaagtggtgataagctcattacggctgaaatggaacgaattgctaaattcgttatggatgatactgacaaaccagttggcctcattggtaatgaactggaagtgaatgtaatccgtaagattattatggaggctcttaatgggaatcagtgaatcccaggctatggctattaaacagttagccttcaactgccttagtgctatgaaggcatttaatgaagcaaaaactttccctgaccagaataaagctcgtattcgactttatcagtctaagaaagattttgaagaatatctggaaagtattatggtgagataatgaaaacaatattaattgttcatgatgctgattttaatgatgtcgataaaatgatgcgtaatattgattatgtagctcagacaactccagcatttaaagaagaatttactctgtactgtgatgctaattcaccattagtccctattctgaaagaagccggtttacccttctatacagataatttccctaaagaacctgattatgtaatttcatttatttatgacttacacgatggctcagaaccaagtgaattggctatgagtcaatggaaatccagaagacctgtatatgcatttcaggttgttaaatcaaggggttaactatgttaggtaataacactaatgctctgtttggagtatcagccagacctattatcattgttaataaacatcacggtaagaagggtgaatatattggacgtggttctcctctaggtaatccattcgttattggcaaagatggaaccagagaagaagtaattgccaaatataaagtatggctacaagaacagattgataaaggtaatccagttgtactggatgaattaaatcgtcttggtaataaagccattgatgaaaaaggattagctttacagtgcttctgttatccaaaaccttgtcatggcgaggttattaaagagaagttagtaaaagctatgtataactactttgtggaaaatcctaatggataaacaatgcaaatgtggtaaaggctatgtatcccaatgggatggtaagtgcggtcattgtagaaccaagaaagaacaacgtgaccacgaatatgcacttcaggaaatgattgtgcctgttgagaatttaggtatggctccacttgaagcttacaaatacataaggagattatgcaaatgaaagaagtattcgtatttggttctaaccttgctggtgtacatggtgctggtgctgcaaagacagcatataagaaacatggagccagatggggtaaagggcatggtcattacggtgacagctatgccattcccactaaagataccaatatcaaaacgatggctattgaagacattcgtacatttgtaaatgccttcattgtctatgctgctaatcatccagaacttaactttaaagttactcgtgtgggttgtggattagctggtattgatgattctgttatggcctctatgtttgaaaatgccactggtaactgttcctttgacttagcatggaaaagctacttaggggatgatttcaactactggggaacgttctaactcatacgttaggcaataagctgctccgcagcttttggtaattaatatgtttaaccaattttggagaatatgcgatgtctactatcgaacatcagatgcacctcgaaaagctgtacaacaagaaccaactgttaccaagaatgcgtcaggagtttgaagaaaactctggtattgatttcaaagccttctttgcacatataggcattgattacaaatttggcattgatgcaatggttcaaatggctctgcataagcgagctgacctaccaacattagttggtacattgcgtcatcactgcaaatctgcacaggaagtagcagacaacctttttaagatggcaagtgaggattgctttaactttgatccgaccatcgacaagttcattgtcatttatacaatcagcgatgacgtacagcatgaactggattcatttcagtatccattacctatggtagtacgtcctaagctactaactaagaattatggtactgggtacttcacatgtaataagagtgtgattcttaagaagaaccatactgacgatgacatctgcttagaccacctgaaccgtatgaacaagattccattgtctatcaattgggatgtagctcatatggttaaaaatgaatgggctaatctggataaaccgaaagaaggtgaaactcgtcaggagtttgaaaaacgtgtacgtgcattccagaaatacgaccgtactgcacatgaagtaatgggtttattgacccaggaaggcaataagttctatctgactcatcgtccggataaacgtggtcgtacctattctcagggataccatgtgaactaccagggaaccagttggaacaaggctgtccttgaatttgctgaaaaagaagtaattgattaagtaatccattaatgcaagccaataggctaagacgcgaggaatatacaatgcaaacttttactgcccgtgaatatctgaaaattgacattgctaataactatggtctggataaagaagactgggatgaccgtattgcatggttcgataagaatgagaacaacctactgaaccttgtaagagaagctgaagaaccagccctgttctacgccggtgttaaagcatggatggacgttaaggaaggtaagccaattggttatcctgttgcactggatgctacatcatctggtctacagattctggcttgtctgactggtgaccgtagagctgctgaactatgtaacgttgttaactatcgtgatgaaagtggcaaagttaaacgtcgtgatgcttatacagttatctacaacaagatgctgaacactcttggtaaaggtgctcgtatcaaacgtaatgactgtaaacaagcaatcatgactgctctgtatggttcagaagctaaaccaaaggaagtatttggtgaaggcattatgctcaacgtatttgaaagcacaatgaatgtggaagcacctgctgtatgggaactgaataaattctggttacagtgtggtaatccagaggctttcgtatatcactgggtaatgccagatggctttaacgtatatatcaaagtaatggtaaatgaagtggagactgtccacttcttagataagccatatgactgtgttcgtaaagtacaaggtactgaagagaagactcgtatgctatctgccaataccactcactctattgatggcctagtagtacgtgagctggttcgtcgttgtgattatgacaagaaccagattgaatacatcaaggctctttgcaatggtgaagctgaatataaggcttctgaaaagaactatggcaaagcaatggaactgtggggctattatgagaagacaggattcctgactgctcgtatctttgattatctggattctgaaactattaaattagtaaatactcaggacattctagacctgattgaatccatgcctaagaagccattccatgtactcactgtacatgactgcttccgttgcctgcctaactatggcaatgacattcgtcgtcagtacaacaacttgttagctactattgctaaaggcgacttactctctttcattatgagccaggttctaggccaagaagttactattggcaaactagacccgactctatgggaagatgtattagaaaccgaatacgctctatcttaataactaaggctatccctacgggggtagcctttatttttttagtaaatcataatggataggcatttaacctatgaggaaattaaaatgcctgttcttaaagtgatgtttcataaagataccaacgtagctactgtactggatgccagtggtagccttagtgatggttccgttgaggtgggtactttccatcaccctgatgaaacgtatcccgatagtgtaactatctatcatggtgtccgtgacctgctgtataaacgcagtgctaaagacccatctcaaactgcttcttacccaaataacattatcaatatgcaagttatcagtattgatatgaaggcaactcctcgcttgattctgggtactgcattgcctcgtgtaatctctactattgaaggtaaagatgtaacctggcatgtagatgttgctggtggtaaagcaccattgacttacaagtggcagtttaaagctaatactgtaggtgctgctttcgctgatattgattccggagagaatcctacagctaaaactgcaactcttattaaccatgcagtaactgctgaatctgctggtacttataaagtcatcgttactgatgctaacggtactactatcgagagttcttctctgctggttgtaggagttcaggaaccacctgaagtagcttctattgttgcttacccaagtccactggctctatcagtggctgatgatattactgaaggtaaaacagttaagttttcttccctgcctgctggctctttgattggtactctgtccattaagacccagcctgacagtggtaaagctactgctgagattagtggtaatgtactgacagttaaacctgtagccgcaggtgacactactgtagtagtcaccaacggaaccaaggaagtaactgttacggttaatgttacagagtaatgtgattgtttttatgaatgtagccctccttgtgagggctttttagtatctataggagagtaaataattatggctaataagaactgtcttcgtgtatggcatatccctcaagtacccggcaaagccttctatgttgaagtagattcagtagaagaaggtgtacgtatcattgatatactagccaactatgacctattccagtatgagaacaatatcaaaggtgattactgcaatgtctctggtttacagatgtatgatgaacatatcactgatgatgaaatggaagagatgggtctgactgaccgttgggtagactggtactatgaagatgaccagagcttttttgataacccgaaagagtatttgaataatctcaagaagtaatttcttggggttaatgacccttattaattccttatcctttgccctcctatggagggcttttttacggagtacaaatgtttaagttcttagaccttatctgggcagtcattttgctggttgctacaggctttgtatatggcttcttgctcccatcaatgatgtctgctttagacagcatcattgttgttatgggcttgatagtctgtattgtgtggcctcttatcgtaggccgtatcgtttatcttacagttaagaaaaggatgagaagaaaacatgtataagtacattgcagtagcaattgcaggactaatcattgctctgagtttaacgagctgctatgaccgagttgaaccaggtaatgtgggtattatcgttaaccgcctcggtgaagataaaggcgtggaaaatgaagttaaaggtgtaggccgttactggctcacttggaatgaagaactctatacattcccgacctttaagcagatgaagacctatgatggtctgttctacttccaactgtctgatggtactcagataggccaccagatggctatcagctataaagtgaatcctactaaggtaactaatatcttccagacgtatcgtaagggggttaatgaaattaccgagcaggatttacgccaacgtattgctgatgtacttaacagacagggtaacctgattaacaccgatacatttattgatggtggtaaatctaagttactggatagtgtcactgacacaatccgtaaagagatggaaccagtggggattgatattattgctatctcctggattggtgctcctgaataccctgataacgttaaacgtgccattaatgccaaagtagaagctactcagaaaactctgcaacgtgagcaagagattcagcaacgcgtagctgaggctaatatggaacgtgaacaagctaagggtgtagcagatgctattctgattaaggctaaagcagaggctgatgctattcgtttacgtggtgaagcactcaccgagaacccaaatgtaatgcaactggaagccattaataagtggaatggtacattacctaccacaatgattcctggggctactacacctttcgttaatgtgaaataactaagcaaacccaccattacggtgggtttattttttgaagttatctaacactggatattcctatgaaagtaaatgttttacgtcgtaagaaagttcctttctttcaaatcaattgtggttcatgttttcaacatgatgatgactactatatgaagtgtagttatcaatctaaagaacacttctatggtgtgaatttacaaacaggtcatctgttcacatttgataataatgactttgtttaccctgtgactttagaagcatgtattcctgacccacttaataaatagtatggctcaagaaaagaatcgtcgtcagacacttatcgaacgtattcaggccagaatcaaattacaggacttaggctataccgttaatggtcagcctagtctctgtcacatctggactggctcacattcaggtaatgggcgtggtgggcaatatggcaggatttccgtgaatggagttacctctgcaactcacattattgcctatacccattatcatggttatatccccaataagatgcaagtagaccatctctgtaataatcgtctgtgctgtaaccctgaacatcttgaattggttactcaccaagagaaccagagaagaagggctaagcgttctaaatctaaaggaaataaataaatgattaaaaaacttatttgtaaacttattgcagcaatcttaattagtattattggtattgcatgggtaatttctactccagataacgttatgcaacaaatttattatgctgtgtatacatcaacctcttttgtttgggtttatgtaatgtaccgtatttgcagcgactaatacttaatatagcttaactggagagtaaaatggctagtattgattctattgccgtatgtaatccacggcaggtacgtaaatttgttgaacactgtatccgttcaggattggttccatttatcacctcatcccctggcatgggtaaatctgcaattgtccatcagattgcagaagactttggcctgaaactgattgaccatcgtctgtctacttcagcaccagaagacctgtcaggtctacctcgttttaaagagaatggtcgtgctgaatttgctccatttgacgagctattcccattggaaggggatgctgtacctgaaggatttaatggctggcttctctttctcgatgagtttaactctgctcgtaaagagattcaggctgctgcttataaactggtactcgaccgtatgactggtcagaagaagctacatccttatgtagctatcgtatgtgctggtaacaaagcaactgaccgtgccattactaacaatctgtctacagctatgcaatcacgtcttattcatctggaaatggagactgattttgacgtcttcatggaagatgtagctatccctaacaagtgggatgaacgtgtaattgcattcctgaatgctaacccaaataaactgaatgattttgaaccagaccatcaagagaagactttctgttgttctcgtacatgggagttcgttaacaagattgtttccattctcccaccaggaccaattgatagtgaaatgactctactgttagcaggcactatcacttctggtgtagcaacatcattcgtccagtttactcaggtctatagcaacatggtgtctttgaatgagattctggataatcctaagaaagctcgtatgcctgaagacaataacctgttgtgggctgtagtcacttcactgattaacaatactgacgaagataatcattcgaaaatctttgattacattgaacgtatgccatttacgttcaaggttttgtactaccgttctgtaggtagtctggttccagctttggttaaattaccgaactggcgtgttgctgcaatcacattatctaaatacgttcatggttccaattaacaaaaaaggagttacagacctcctgtatgttgctggctttaacggtgaagaaattaccgtatatgccccaagtctggctgctgctaaacaaaaggcagttgaatactttcgtccaaagaaacgtgtaacccataccatttgggttcatctcgcagaggaaaactgatatgtccatgacagatgctcaattaacccgtgaatatgacagatgtcaggctaaagcctttatgggcaaaactgctgcattctttggttcactgttatgttctctgaagttccgttgggtaaaagatggctgtgatacagcacaaaccgatggtgagcatctcgaatggaatcctgattggtttgaaagtctattacctgaatctcgtgtaacagtacttatgcatgaactatggcatgtcggcttactgcattctgttcgtatgggttctcgtgacccagaagtatggaattatgcctgtgatatttatatcaacaatcagcttattcaggatggctacagctttataggaatcgaaaattgctggaaagaccctaagtatgctggttgggctgaagaacaaatctatgatgacctcatgagcaaacagatgcgtcctcctaaagcatttggtgcttttgggactggctcaggtggtgacatgaaaccttccacttcgaaggctagtcaggtaaatattgtcaataatgtagtaagagccatgcaccaacagaaactatctggtggtcctttgcctggggtattacctggaaaaatggaagaagttattactcaattcctgaaaccagtagtaccgtggcaggttttacttgaacgcttcttcaatgacctgcaagaaacttactactcatggcaacgacctaatcgtagataccctgatatgtacctaccatctcctatggatgatgacggtagactagaacatctggcttatttcctcgatacatctggctccattaaacctaaagatgctttacgctttagctctgaagtggcctatgtaaaagagaaatatcagcctcagaagatgactctagttcagttcactacagagattgtagatgagcaagtcattgaagatggtgataagtttactgatgtcactatcaaaggacggggtggtactagtctggttcctgtacgtgagtggattattaagcataagcctactgctgccattatctttactgacttagaagtcagaccgatggaaccattgccatttgatattcctgtcatatgggtagttattcgtaaccctggtgcacaagttccatttgggaaagttattaacattacatgaggttttatggttgttaatggaaaactattgttaggtgctatgcccattaagggcatggtcaacagtaaactcagttcaggtgagactacatttgggctaggggaagctggttatgacatccgtattaaacaggatgttaccttctaccgatttcttggtttgattccctgtatcaagattaaggatgaaggaaagaccaagtggaagtttggcactttcacattagcttctgcaatggaacgtttcaatgtacctgctggcctagtaggtattgtccatgacaaatctacatgggcaaggcgtacattatctgtattcaataccgttattgaaccaggatggtcaggctatctgactttagaactggtttatcacggtcgtaaaaaacttcatatccctgctggttcaggtattgctcaagtcatcttccatgagacagtagagaatactgcctacaatgggcgataccagaaccagcccaatcaacctgtagctgctaagtcagctcgttaattaaggaaatatcatgtctatctttactactaaggttaatggtcagaaagttactgttgttgctcgtaacgtagcttacgttactgaaaacagtgaaggccgtggtgtaattacttttactaacggtgattccattgacacccaggtaggttatgactctatccgtcgtaacgtagctaaagcacttgatggtgctaaagacaccgcagagtaaggtgtttacagtaatggggttatacagtagccccatttatggaaattcctctctctccattgcttagtcccaactatgcccactttatgtgggcttttttaattagagactatgtatgagcaaactaggtatacacgtttacatagatgaagccgagaagatatacccctatatattatttagttccagtgatttacttcagatgaaggtaaactccatcatcgtaaactactggtataacgataagaattgggattactgggctgcacgacagaagagtaagaacaagaaagatatattcaaaagcaaatcaactccacatatgtttccttggtatcacagaaaccggagatattgatgacaagaataccatttttaaaacctagaaaacgaacaccaaagctgtatcaaaagacttcagaagacggtttagccttgaaccagaaagctattaaggccgttagtacactggttcaaggtaaacaggatgctgttgctttacgtcttgttgttgagcaaatcttagttgctctggcactggctcaggtagctaaacaagaaggtaaacaagaaacctgtaaaacagcattaggtgctttgtactggttgtataaagaccttgctgacaactttgaaatgtctatggataagtggcagggcatttcttgtgtacttgctcttagagaaggacaggaattgctgtctactctaccaaaagcagaatttaaactagcctacactggagcacataagattgttcttggttccagtaaggacatctttaaccacctcaagttattcaaggctttctatgattaatgcaaaaatcctcgctgatagtattactctttctggtgaccgcctggtaacaatggaactggtttatccgcgtttcattcattcagaatttatgactcaccgagcacttaatcgtaatgcttccagtagtcgtgctattcctacccaacgccttattgagcaagttcgtaatgaaccagtaatgccagtacattggggtaagaaccagaaaggaatgcaggcaagtgaagaactcactcctatggagattaaggatgctgagttcatttgggaaaatgctgcctctgctgctgctgtgtatgctgaacaacttcgtcgcggacaagtacataagcagattgttaatcgtattctggaaccattcacgcatatccgtgtagtagtgacagctactcaatggaataacttctttggtttacgcattcatcccgatgctcaaccagagatttgtgaattggctactaagatgaaggaacagtatgaccaatcaaaaccccgtaccctgttggctggggaatggcatttgccgtacatcactaatagtgattacctcgatgcttacgattattgcaaacatcaacgaattactcgtgatgaaccaagtagtgatgagattaattgcctgttagtaaaaatctctgctgctcgttgtgctcgtgcttcctataacaactttaaaggtactccttctactatcgaagaagacctgcgtttgttctctaaattggttgaaagtaaacctgttcacgcaagtcctactgaacaccaagcaactcctcagcatgtaatgagtaaaggcttaaatgagcctactgacccatctacatgggaaaatggcattagtcacatggacagagatttacgtctatactcaggtaatctgtgtggctggattcaattccgtaagctgcttgcagatgaatgcatccactaagtaggtcttttgtgggtgtagaccactcataataaactccgctatttgcctcctacatggaggcaatttttttgattccatgtacataggaggccatatggttaaaccacgtaaattccgtattaaggataagcctgtaatgggtagtgctgctggtcagtcacatgagaaaggggacattgtttatgaatgccttcagtatgattacggcgttgctcatgatgacactcgtgctactggtgtcccacatacctcagtaactcttgaggaagatggtagttacccattcttcactgttcctactcataacctggaagaaattcatgattgacccaaatatcatccatgccaaaacaggcgaatcccataagctgtctgaatattccaaagtagaagatattgcagtttgtcctgcaaatattgcttctctttgtatctgtattgcagagctatctaaagaacgccaactatggctatctcctaataaaacaatggttcaggcaggtctggcagaagtacaacgtatgctggatgaatggtctgaagaccagatgttcattgatggcaatgcagaagcaataaccgatgatatggcctctgatatggctgtgtttgtattacaagcaatggctgaaaagcgtagtagttaattaataatttactggagaaaattcgatgcaagtagttgactctactgaactgaccacatcagcaacgttgggtgctcaagatgctatggccttcggtatttctgaagacccagcattcttccaaatactcagtgctaacctctattctaatcagaaactggcaatggtacgtgagacattgtgcaatagctgggatgctcatattgaggggaataaaacagatattcctatccatgtaaccattgataaagatggtttccttgtcttccgtgactatggttctggtattcctaaagataagattcaagaggtctatggggtatatggtgcatctaccaagaaagctaatactgcttccactggtggctttggcttaggatgtaaatcccctatggcctatacagacagttttactgtcacatctatgtgtgacggaaccaagactgtctatcacattgctaaatcttctgttgagactaacggtaaaccagggattattcctatcgttagcgtacctactgaagaatcagggcttgaagttaaaattcagcttcagtcagaagatgttttagaaattgattcatatattcgagccattgtattacatggcgagattaaatgtatttactgcaatcagtatacaggaccaaatacagtagagttattgcctgtactgagcatgtcttttgaaccaggtagctataacctagaccataacacatggcataaatattacatgggcagtcattcaatatttatccgttatggcaatgttatgtatcctgctttggacacccctgctacacatgaagcattaaaactggttaaacagtttatgcaggttattaactgtagccgtatcgttgttcaagctgccccatcatcactagctgtagcacctagccgtgaaacactgtcatctcaaaaaatgaccgaagatggtattgtaaatttggctgtagctttagtagataaaatggaagcagatattaaagctcgtcttccaaatgctattgaatatattgggaaagctattaaagaatatagccctcaccgttttgaggtaaatagttatttgccttacaccaatttagtgcctgatgttattgtcagtcgttacatgtcctctactttattcagtaagcaatatgctcatctgtgtaagaaatggggaaatatggaaattgaccgtcagcttgaacatcctgcactggctcatttctctggttctcaaaaagcccatctccgtaagcatttaaagagggctaaggatttacgtaattacagggaattaactaaagtatttactgatatggctattaagccgatgttcaaaacctttgctaaattgggaattactaaaggtatttctctatttcattatcaatatggtgttgaactgtggcgtaataatattgttaatagtgtccgtagaatacactcattaaacttcatgacttatagttctaagaagtgccgtgtatttgttaccccacgtattaccaatattgaagatagtctggctgggtatcccgaatttgataatctttctaccgagacactggtgaaatataactcaatcattatcaaagttggaaccaagaaaggtgaagcagaggctatgactaatctgctcactaaagcaggatacgaagtcattaatatggctgaatatcatgaatgggattgtatagctcgtagacgtaaagaggaacaagaagctaaattagccatttccaaattacaagctaagaaagctgctaataagaaaaaggtcagtcctaatcgtcttattagtatgaatatccttgaaataccaaaagagcatcgtagctattcaagtgaggtatgtggttctcactacgcttctcgttctcatgaccgaatggttgatgtagatactcctcagtattacatcatgcaggaagatattaataactacacaggaaggcttggtgttctttctatgtggcaattaacccctgctaccattaaagctgtaactgttgtttgtcgtaataaaattgaacgtaataaagctattaagcgaggtgctgttcatttggatgaatggactgctccgtatattgcttcagttcttacatccaaacaattcattaagtatgtcactaaagaacgtcagaaaacgttaagtgatattggtatttactccaaacacctcagattactgagagaactggatattacatatgccccattgaaaggtctgcgttatgacccagaactggagaatgcttatctcttcttacaaagtagtagctaccctaagctacgtgcattgttagggaagggtctgattactgaagaagagtatcacttcctcagtgatgttgatgtgcattgcaagactttcagtaagtactcggaacttcgtaggataccgaagatgttccttgatattgatgctgggggttatatgttggctgcatgtactgtagacacattgcttcgtgaaatcgaacaattccctgaatcaatccctgcaatcaaactgcttgtaaaagctgctcttaaacggaatacagactgatgaaacgaaattatctcgccattattgccctgtcagtagacagtcgtaacctcaccctatggcaaccagatggttctactatggtcatcccccaaggggatgcccgtgtaccacgtattgttgctgaagcaaaagaaaagaatcttaccccagataagattatcgaagtggatgtcactatcgaagctcagattcgtcaggagtttctggacgctgaacgtgatacgggtggctttgttaaattcttccgtattaccaagaagaagctacaagagttcttcttaggggaagaggaagagcaagtccctcatgtatcacctgtggagttaggtgctaaaccaactgctttcaatgcttttattgctaatgctgtaggcaaaactcttgctgtacaacatgcatcattaaaagcacctgaaccagaaatgacggttactcatgagcgtttttacggtagctatgctgtatggattacagatgtagacccacggaatcatcgtattgaggttattcatgttatccgtgaaatctcaggaagaaccagtgaatatgtcaataacctactggctcaaccaaccccattcaaagtatttgattggctcacagagactcaggctaaagagtttgtaagacgtctgaataacactcagggtgttatctctgtctataacaaactggaagacggtattcctgctaaggttgccgtgaaagctacagagccaaccaataaagaaaagctggaagctgcatcaactaagctgaaagctatgggtgctgtcgctactgatgcttatgaatttcatactgacttgaatgaaaatgaagagactattgtagctgtagtgaatgataaggtggttcctgatgttcagaacctacaccgtcatatccgtcaatctgcaaatttgaaagactataaaggctttactaagtttcttgaacgtctgtctactgtaattgataaacgtcgtcactctgttgaagacctgatgaagtttatggaaaaaggtgacctgccaattgcagatgatggctccattgttatcttcaaacgtctggaaagcaaagacaatcctgaacatctcaaagacgtaatggatgatgtatttgttgattgccattctaagaagattgagcaatgcgttggtatgcgtgtaatggttaaagaaaaccttgtagaccagaaccgtcgtaaagactgttctcatggtctgcacgtagcttctctgcaatacattcgtaatttctcaggcaacgtaaccattattggtaaagttgctccagaggatgtatttgcagtaccagaatacgatgttactaagatgcgtgtatctgcttatcacatcattaccaagctacctgatgctattcgtgaccatgttaataatggcaatccaatctccaccattgagggcggtacggaaatcctgaacatggttctcagtggtaatcaccctgaaccttcccgtcaggtactggttggtggtcattatggaaccaatctgacttattcagaactcactcgtaattatctggatgatgatgaagacagcgttattccagatgaaccagtaattaagaaaactgccttgaatatggaagagagctttacggcaactaatcctaaagctgaaccagtgaaggcaacggatgttaaacctattaagaagactaagatggaaattcttaaagacctttggaaccagttcctgaaagcagagacttctaatgaagctattacactggctgatgaaatcattgctgctaagagcaaatgtaagaagtcatgggcttctttaggcttcagtggtgacatggttcagaaactgattgatgctcgtgctaataagcctaagccggaaaaagcagttaaacaggataaaactgttgcacctaagaaagctacagtcacccgtagccggaatgctgatgttattcgtagttatctgaatgacaagggtatgtctgattactgtaaagctcatgccattcacgatgtgaaacgtgctgctaagaaatcttatgctgcactggggctgactcctgaagaatgtagccaaattgataaactgaagcatcatctgaagtaagtaggttaactattcaagtagctccggttgaaatatactggagctatctttgaagaggatacatactatggccaaagtttatcgtgctaaccgtaaagcccatgatgacgatattattcgtatgaatgcagtcggtttatcattgggaaccattgctaaaacactaggtgttcacccaactacagttaccttacgattacgctctcttggtattgaaccagccgacacgcgtcgaacatttatggagaacgtactagcaccattacctactcacgtagctgattggttatcagaacaagtaggaccaaagtatgagattcgacaatacgttcgagacttattactggaagcctacaataatcgtcataatcataaggaaactgctcatgaacgattcctcaaaagatacgttggtacaaactcagaactggtttctgaaggcagtacccaacccaacgagtaaaaacattagtacccaaattggttgtcatctggaagaagtagttgagatgctggaagaattggctccaaattctgaagaagcatacgatacacttcataatgccattgcagctttaactgaattgtcagaattaatgaagtcctctgataaagaagtttatgcacctaacagcaatcgcttggctgttctggatgcactggcagaccagattgttacagcaactggcatcggtactttcttgggtatgaacgtacccggagcactcactgaagtaaaccgttctaattattcaaaatttgaagacggtgagcctgttttcaatgagaataagaaagtaatgaaaggtaaggattacactccgcctgatttaaccccattcatttaaaagagccgcccatatagggcggtttttgtatctggagaactcatgtataaaagtactactaagctgccactaaatcctggtcaagaggcagcggcagaaggtttcttcgactttctgctcgaccccaatgcttctgaacttcgtattagtggacctggtggtacaggcaagacatttacaatggctcatatgattgacgagattatgcctcgttattatgagacatgtagtctgatgggaatccctgctctctataacgaagttattatgactgctactactaataaggcagcagaagtattagcccgcgcaacaggacgtcctacgtctacctatcattcctttcaaggtctgacagtacgaaataacctgaagactggagaagcagacctgattccgtctaagtccttcagtatcaaaaagaataaggtcatttttattgatgaagcatcaatgattgaccgtaaactgaagaagtttattaacgaaggtactcaccaaagtaagattgtttacttaggtgataaatgccaattgttacctgtaaaggaaacttcttcccctgtctacaatgacagtagcattaaagagtttatgctgacccagcagatgcgtactgatgtccctgaactccatgcactgcatgaacagcttcgtggaaccattgaaggtaagcatggattcctgcctattaaagcagttccaggtattatcgactggattgaagatggtgatgaaatgaggaaagaagtcgaaggtcatttcatgactaagacggacactcgtattgttgcctataccaaccaacaggttgttaactataacaccttcattcgagccatgaatggattccatggagagttctgtattggtgaagagttagtaagtaactctgctattcagattggtgctggtgaccgccttagtattgaacaggaatgccagattgttgaccaggattctgctacccgtaagattctgattgattcctctggcatcgaattagaagtacgtgattgcaccctggatactggttatggtggtgtctttgaaggtatccctattccggtagatatggattatttcattcgtttgcaaaagtactatgcacaccaaaagaactgggaacgccacttctatttgaaagaaacattccctgaacttcgagcattacatgcttctactgtgcataagtctcaaggttctacctacgacaccatctttattgatgctactgatttatctacttgccgtcagcctgatgtagtagcacgtctgctttatgtagcagtatctcgtgctcgtcatcgtgttgtgttctatggctctttggcagagaaatttggtggtctggttcgctaaggagaacttatgcaactgggtgaaaaacaaatccgtgaaatgactaatagtagtgaactggttcaggaattattcttagccgagttacgtcggctagataaagtgctggatagtatcattacacgtaatggggaaacattcgctgtatacaactcaacaggattcctgtatttaggggagttctattcgagttctcgttcatcacaacaacctccttctggtcatcgtctggctctggctaatcacctactggatgatatgcgggagtatctggaacaagcaggtaaacttctgctagaagtccatatggtaaatcagatggtctttcgtctggttcagggttgtaagacttatcaagatgttcgtgatgcattgccggaatgcctcattgctatggataaacaagggcatctgaaatccttacagagaaccagaaaggcagcatttactctggataatgatgctatggctctccgtcagtatgagaaaatcctgccgattatcgaatactatgcgggaacccatcttatcttttgaggtctgtatgcgtcacattacattcaacaatgagggtatctaccctattgctatccttactacaacgttacgtaaggatgatattgtcaaagcatacatggaaccctgggatgtagataaagattcagtaatgattcttgaacttcatacagccccagggaaaaagaaaactcctgctaaagagatgcaggagtttattacccaagaattagtgccagcattcgaagcagcacaaactcagtatatcatctgtggtgattctgaatattacaaacagctaaccaaacaaggtaaagctgatgccaatattggctatgtaatggattgtgcttatgggaaccagaaagttatttacgttcccaattacagacaaatcttttatgacccggataaggtaaagactaagattgctttgtccatgcaggctctgattgattatgtctctggttcctatgttgaaccaggaactaagattatccactatgctgattatccattaactccagaagctatatctaagtggttagataagttactggagatgaatgttccattagcagtagatatagaaaccttcagtctgaagcattatgactgtggtataggcactattacattctgttggaacaagcatgaagggattgcattccctgtggattatgagccaattgagggggctaccgaagccccttatggtagacaggttcacaacatgcttgttcgctctatgctcagagacttttttattaagtatctgaacaggcagatgtatcacaatattgcctttgacgtatatgcactcatttaccagttatttatgacagaccttctggatacggaaggattgttgcatggcatgagtatcatgctaagaaactgggattgcactaagttaattacctatctggctactaattcttgtgctggtaataagctaagtcttaaagaccaagctcaggaatatgctggtaactatgctcaggaagaaatcaatgacattaccagaatcccattagcagagttgttggaatacaacttagtagatggattgtgtacctggtatgtctatgaaaagcattgggatactctggttaatgaccaacagttagatgtttatacaaacatctttaaacctgcatgtgaagatattattcaaatgcagttaactggtatgcctatcaatatgaagacagtattggaggtagaagaggcattaacccaagactataacaatgcgttaaaaacgattgctgacagtaaagtaatcaaagatttcacccgtcttcttaatgaagaatgggtagaaaaacagaaccagattctgaagaagaaacgagtaactttagctgatgctaaagagcagtttaatccaaactcaggtgttcaattacagaagctactttttgagttcctggagttacctgtgctgggtctgactgcaagtaaactacccgctacaggtagtggcatactcaagtctttgaagaaccatacccaagataccagtatcctggaaattcttgatgctctgattgattacaaagctgtagataaaattctgacagcattcatcccagcattaaaaaatgccagacaaggaccagatggttggcattatctctttggtaatctgaacttaggtgggactgtatcaggccgtctatccagtagtgaaccgaacctacagaacctaccttctggttccagatatgccaagatgattaaaaaatgctttgaggctcctcctggatggatattttgtgggctagactttgcttctctcgaagaccgtatatctgctttaacaaccaaagaccctaacaagctgaaggtgtacatgggtgtgactgtttatacagttactatagaaggagttgaccatcatatccgagatgatgatacaatcgtttatgatggtaaaacttataccggtgaggagttctatgacgcttttacccgtggccttctatgaacaacggtataagatttccgatgaaggtttcatcttaaatcttgcaaacaatcaacccctaaaaccgactctcaatcctaacggataccttaaggttgggttagctaatggtgatggtacacatcatcaagagctacttcatattctggtagctaaacacttcatccctaatccttatggctataaacaggtgaaccatagagatggtaataaactgcattgtcataaggataatctggaatggtgctctgctactcagaatgttgaacatgcacttaaaacaaggctacgtcctggttacatgtctgctgacgataaagagaaatatctctttgaggtgctggcaggcaagcaagttaaagacatcgcttttgaaataggtagacgtcctgaaactttgcataagatgcttagaactaccgctgaccgacttggtgttcgaaatgagtgggatgatgttatgaggagaaatagaaaagatgttactttacgacagcttgccaaaatcaactcatgacttcactggcaagaaaattgacaacgtagtcaaagccgggagttcatcaggttacgatgggcatagccttcgtgcatatgcttacttcggtgagatgatgcccgacattaaagatacggtagagtctgttaattctattcaggagaagtacaaagcataccgtcaggattctaaagcacctacctttgctcttacctatcagggtacgtacatcactttgatgaagaactgtggtttccctgaacagaaagctcgaatggttgaggaacgttatcacacactttataaggtaagtgatgactgggttcaggctaaactagaccaagctgcaaaagatggttatgtaaccgtagcatttggtttacgagtcagaacccccttacttcaacaagttattcgtggaaccagtaaaaccccttatgaagctgaagctgaaggacgtactgctggtaatgcattaggccaaagttggtgtcttctgaataaccgtgctggttctgagttcatgcgtaaggtgcggaatagtaagcatcgtcttgatattcgcccaagtacccatattcatgatgctcagtatttccttatccgtgatgatatggatgttgtgatatataccaatactcatttggtgaaagcagtacaatggcaagaccatcctgatattgctcatccagatgttcatttgggtggggaactctccttattctacccaacgtgggctaacgagattgagattccaaactacgctacgcccgaacaagtccatgaagcaatccaaaaggcatttaaatgaccaaacaaattgaagagaaaaagcatcactggttagtagcagctcaactgacttttgttattcctgataacaaagatggtcaggaaggtgctgttattgttcagaacactatgctgcttactgaagagaaacaggtaactttccgtgacctgggacgtgctcagtctgctctgtttcagaatctgaatgaccgttttggtcaagtagtagatgtacgggatattgtattcctgaacgttagctacctgggtcatatgagccagcctgacttccagcaaaatctggtaactaaagatactgctgcgaagaaagctaaactgaaagctgtggagtaatcatgtctgaaaaactgtcaggtggttttaataactactatctggttcaggtaaccaaccctcaacgtatggaacagcccccatatcaagccgagtgtgaggatattatccaagcactgaatatgacctttgatgaagggtgtctgttcaaggcattgtggcgtaatgctgctgctcgtttaggtaatggtaaaccaggtaacactgccgtttatgatgcagagaagatggttcattatgctaaccgcattcttattaaagaatccggtgggcagaaaaaagaagcagaagaaccaatctctgaagctctgaagaggggtgaagagattcatatgtctctgtctgaattattcaccttgttaactggtgaagcagcagaaggtgaagtaatgagccttgctggttggcatactcatgtacccaaccgtttgggtgttatgcctgttgctgttgcaatgagcaaagcagaacaagttgatgtagtacgtgccgatggaacgactattactcatgtatttcctcatgagattgactggtctgataagattgccccctttgctcgaatcactgcatggcgtttcagtaacccatctaaggtcgcttctaaatgaaaatcacgaacaatcatgacgtgtccttgccattagctgtctggcttttgcatgacgagtatgattacgtgaaggataaaaagtatctttctgtgactaccctgcttaagccaattaagcacattgtcatgaagcatcgtgtagacctttctgtagaaagtatggacatcatggatttggtgtccacttctatgggtacaggcttacatgattctattgagaaggcatggcataacggacaccacaatgcattacgcaagttagggtatcctgagcgtgtcgttcagaatgttgtcatcaaccctacccctgagcagattgcatcaaatccaaacttaattcctgtatggatagaacaacgagcaactaaaaagattgctggttggactattgggggcaagttcgacatcgttactgaaggtcttcttcaggatgtaaaatccacctccacttacacatgggtaaagggtgggcgtgatgaagaacatagacttcaggggtcaatgtatcgttggttacatgacgacaagattaccgaagatgtgattcgtattaactacatcttcactgactggatgaaagcattagctacatctcaagaaaactatccaaagcatcgtgtgctgcataaagacattccattgatgtcttatgaagcgactgaagaatggattaaagccaagctggctctcattgataagtactgggatgctcctgaaagcgagattccagaatgtactgatgaagagttatggcgttctgacccagtgtttaaatactttgctgacccagagaaagcaaaacaacctggtgctcgttctaccaaaaactttcctactctctttgaggcacggaagttcatggcagagaaaggcaaaggcactattcttcatgttcctggtgaacctaaacgatgcaactattgctcaatttttaacatctgcgaacaaagaaagagatatttcccatgattgacctgaccggagtctcacatcatccggcgattgaagaaatcgttgatgtgttatgtaacaagacgcaaaacactgatcgtggttttttccgtgtagaagtggcctatttccttgcgaaaatggcttcatgtatgggtgcaactatcatcactaaagaccgtggtgaaattccagtaaacatctatgcagtggctcttgctacttcaggcttcggtaaaggccattcggtcaacattgttgaagacggttttatggctggctttaagaaacggtttatggaagacaccatgcctgctttagcagaagaccgtctgtggaaaattgctaacgaacgttctgctcgtaatgctactgaccagaaggaagagtttgacaaggtggaagctgaatacagacgtacgggtgcttatccatttacgtttgactcaggtacacctcctgctgtgaaacagttacgtcataaactcttattagctggatgtggtgctattaacttacagattgatgagattggttcaaaccttctcgctaatgctgatgtattaactgtgttccttgagttgtatgaccaaggcaagattaaacagaaacttactaagaatactgctgaaagtattcgtagtgaggaagttgatggtaaaactccagctaaccttcttctgtttggtacaccgagcaaacttctcaatgggagccagactgaggaactcttctatgacttccttgatactggttattcccgtcgttgtctgtttgctgtaggtcaggcagataaacgtgcatatctgagccagagtgctgaagaaatctatcgtaatctgattaagcaggataacaatgctgttgtgaataagtgggctaaccactttcatagccttgcagatgcatccaagtttggttggaaaatgacagttgaagatgatgttggtattgcactaatcgactacaagattcagtgtgaaaagcaagcagcagctttagctgaccatgaagaaattcgtaaagcagaactggaacatcgctattttaaagcactgaaattggcaggtgcatttgcatttgttgataacagtatcatggtagagatggaacacctgaagcaagcaattcttctggtagaagagtctggtgttgcattccagactatcctcaatcgtgaaaaagcctacgttaaattagccaagtatattgcatctgttggtactgaggttactcatgcagatttgcttgaggctttgccattctataagagtgggaatgctgcacgtaatgagatgatgactttagctactgcatggggctataagcagcatatcatcattaagaagacatacaacgaaggtattgagttcttccgtggtgagacactgaaagagactgatactaacgaaatgattgtttcttatggtgagaactttgcttatgactatattgcagagaaagttccatttgaccagttacatgtactgacccagcaagcaggttatcactgggctaaccatcatttccgtcgagggcatcgtgctgaagagaatgctattgctggcttcaatatgattgtcattgatgtggatggtacgtgtagtttggacgtgtgccatgaattgatgaaagaataccgattcatgacctatacgaccaaacgccatactgatgaagaaaaccgtttccggttaattattccaatgaactatcagcttgaacttgatggtgctgagtataaagagttcatggataacgttatggcatggctcccatttaaaacggacgagtctgctaatcaacgagccaagaaatgggaatcatgtgctaagggtacgtattactacaatatggatgctcccctgctagacgtaagagatttcattcctagaaccagtaagaatgaggcattccagcaagggatgcagaaggttcaaaatctggataatctcgaacgttggtttgcccaacgaattgctacaggcaatcgtaataaccacatgattaagtatgctctggctctggtagatagtggtataggcttcaatgaagttaaacaacgtgtgcatgagttcaataagaaactcagcaatcccctatctgctgatgaactggattccactgtaatgattactgtggctaaacgttacacatcttaataaaaactattcagtccttttcttggttgaagaggactgtcagttaaaagaggaaactatgtcagaagaatttgaacatggcgaaatgaatgaccagctaatcctgattgtaggattttctgctgctggtaaatcagcctcacttcgtaacatccgtaaccaggaacgttgggtatatctgaatacagaagctggtaaacgtctgccatttaagaataacttcaatggtgttcgtattactgacccataccaaatcctggaatactttgaccaatgcattgaacatcgtgatgacgtggacggaatcattgtagattccctgactttcatgatggatatgctggaaactcagtatgtactcactgctgcaaacactcagaaggcttggggtgaatttgcacagttcttcaaaattctccttcaggagaaagtagttaaatttgccaaaccagttatcttcactgctcacgtcaaagacgaagtagatgaacgtgcaatggaactgaagactttcgttccagtaaaaggttctctgaagaacaatggtattgaagcatacttctctactgttgtatcagcagaacgtatcgaccttaaagaacttgaaaagtattccaatggaatgttggaaattactgaggatgagcaagagttggggtacaaacacgtattccagactcggcctactaagaaaacagtaggtaaacgtattcgttctcctatgggtatgttcagtaagcaagagacttatatggacaatgatgcccaaaaacttctcgaccatctggcagagtattactctaccggtgcttaatctggttgttagtcattcattaatttaattaagtaggaaatataaatgagcaatttattcggaaatctggcaggtcaggcagctaaagcagagaaagcaacggataacctgggtggtggatttggtgcaaaagaatctgacatttatctggctaccctgaaagtagcttatgcaggtaaagcagcttctggtgctaacttcattcagattattgcagacctgactgaccttgatgggcacagtgctggtgaataccgtgaacaactgtacatcacttctggtactgaaaaaggctgcaagtgtacttatgagaagaatggtaaggaatacttcctgccaggctacactgtaattaatgacatcctggtaatgacttctggtgagactattcctgaagcagtcttcgaagagaaagtcgttaacgtatatgacttcgatgagaagaaagaagttgccaaatctgtcatggttccagtcaatgctatcggtggtaagtttgctgtagctattctgaaatctgaagaagataagcagactaaagatggctccggtaactatgtgtctactggtgaaactcgtttcactaataccatcgaaaaagtattccatcctgacctgcatctgactgttgttgaagcagaagaactgactgaacgtggtaaagaactgaccgttgaagaagcagtcttctgggacaaatggttggagaaaaacaaaggcgttacccgtgataaaaccactaaaggtggtgcttccggtaaaactggtcagccaccaaaaccaggtgctactaacactggtgcgggtgcttctgctgcaaaatctctgttcggtaagaaataatgcagatacctgtgcttggagttgaccccagttttcgtaactggggactagcacggggaatgctcgacttagagacgggaatactctctggattagacctgaagctggtagaaaccaaacccgatggaaccaagcaagtaaggcagaacagcaaagatatgcaagctgctgaagacattactgctggtgtcatcgactggttcaaagaagcaaaggtcatctttgtagaggttcccgttggttcacaaagtgccaatggaatgaaatcctatggtgtttgtgtaggcatcttaggagcactcagggcattagggcatgagattattgaagttactcctatcgagaacaaagtagctctgtctggtattaagactgcttctaaagatgtgatgattagagcagctacaggattttatccagaagccaactggcttaaggataccaaaggtaggctgctcaataagaacgagcatttagctgatgctgtaggtgctatccatgcaggagtactcactcctgctttccagaatttaatgagaattttatcaaaggtataacaatgcaagtaatcctgacccaacctgaaatcgaagctgctctgactggttatgtaaacgacctgatgtctgtacgtgaaggtatggaaatcaaagtaaccttcaaagctacccgtggtgatgacggtgctactgcaatcgtagatattgtccctgccggttcccaatctgttgaagtggttgaggaaccaaagaaagagtcaaaggaacgcaagcatcgtccggtaacccagaccaatactgctgctgtcagtgctctggcttctgctactggtaagaaaaaagaagaagtagttgaagtagaaactactactgaaactgttgatgaaactgttgaagtagctgaagaagctgctgctcaggaagaagaaaaagaagtacaggaagaagaggctaaagaaccagtacaagccaaaccttctctgtttgcaggtctgaaacgttaatatctgggtaaacggtggctacaaagctactgctgggtgtggtggtgtttatagttttgattcttcttattgtcagaattatagacgtgtcggctccatatctagcattcattatcaccgtcattatcttgtataagtgctgtggtagtggtggtggtgacactaagccgccagatgtttaactaataagaggcgactggattactctccccagtcgcttcgttagtttattcatcgcttagtaaatatccaaataaagaaagaagttgtttcttgaaattagttactgcttgtaagagcagataagtttgtagtataactacgctcaaccaagatggtgtagctcagtggtagagcagttggctgttaaccaactggtcgatggttcgaatccatccaccatcgccaaatttggaaggttgtcagagaggccgattgtacctgacttgaaatcaggaggcgcagagatgcacccgaaggttcaaatccttcaccttccaccaaattgctggtttagctcagttggtagagcaattgccttgtaagcaatgggtcaatggttcaagtccattaaccagcaccaatacaggttattagtgaacacactatggaacctcccagcttcctccagatgtacggcaatacattagctggtagtgtgttcactgataggttgtactatcacagtccagacaatatctgcgtgacttaaaaaacagatggagccaggtggaatccctggcaattaattccggtgtaggtactagtgtcgtgcacggcatgagtgttctggttcgagtccagacgccggaaccaatttgaaagaactcttattttggttaccgcaaaagaagtgaaaaatgttgtggaaaactacttcccaattaggttcgaatcctaaaccagagtaagagttctttcgaattgaagatttacaggatatagctcagtttggtagagcgtctgctttgggagcagaatgtcgtaggttcgaatcctgctatcctgaccaaattagtgctctggtatattacttttaacccctaggttatgccacagtaatacaacagattgggtcatctgaaaccagagcactaacctaatgtgtgggatgtaacagttaaatccagttgccggaagtgcaattctagatacgctgccaatgtatgaacggtaaggctgtacaggactcggactcccatcccacctccttatttgaaccaggtatgaacggcttacttagtattaactgcataggggtatgttagggatacttaggtggtaagcagttggtaagaatccaacatggttcattccctattagcagtaacatagtcctgagtacgtgtgctctaaagacaatattggtgagacagtccaatagctgctaaattaaattcgtccattcctcttggatgtgtagcgagtgaaggtaacacttaaaaatccataacccacagaagcctccagttaatcctggaggcttttttatttaattaaataaggaatcaagatgaaccgtattactgaagaacatattgatagcatcattgaaggtgtttactacttcaatatggctaaagctgtagagaatgaggcagttctgattcctgaagcccatttaaaagcattgagcacaactactgtttgtgcactggttctttctaatggattcactattactggtaaatctgcctgtgttgaccccaacaccttcaatgaagagttaggtaagaaatatgcttacgaacaggccattgataaagtatgggaattggaaggctatctgcttaagcaaaacctgtatgagaaagctcagagccaggaaatgctgaaaggattcctgcaagatgacaactgtgaaggtgggggctgtaaaatctaatggaaattaaagttcactttactaattacatcggaaccaaatgtgtaaatggtttcccgatgaacaaaactgactactgcaaacttcgtggttgggatgtacctgctaatgaagacccgttagaagaaggttacttagtagagtatcccgattctaaacctaaccatgaacaattctgtggctacattagctggtcacctaaagctgcatttgaagaagcatactgtgatgtagacaaaggctgcacgtttggtcacgcagtagagcttatgaaatcaggttttagaatgtctcgtaaaggctggaatgggaaaggaatgtatatcaccttagtatccggtgaaaactgggctatggataaacatgaaaataccgtatgcatgaaacgggattggctgggtattaaaaccgctgacaatgagtttatgccctgggttccatctcaatcagatgtattagcagaagattgggtattagcttagtagaaattaaagcccctcattagaggggcattttttattagtgggtaaggttgaaccaaggattgagggtaggtgctcttagcccttgtccgaaacctaatgaataatccagtcttccttcagccagcatggttagcatgttgtcctgaattggcagacctacattaccaaacatggcaggagcaggtactactgtagcaatcagagaatgtactgggttgtttctaatcatgctcatagcaactttaatagaacgaattttaaagttgtagaaccacatcagacccatactttccatatagccacggaaacgaccaggcaatctgtcatagttaataaactcttcagttacctgacccaatgcttcagaagaagacttcttcttacgtttcactaaatcatcatagatgatggctttagcaatgaagtctgaatactctaccgttttctggataccctgaaacagagcagtgtccttagcaataagagcataacggccagcattacgtactttttctgggagtttattagcaagtttttccatgtattcatgaatcttaccttcagctactaacaggtcatcacgactaataccggcatcagcaatagaagagaactcacctgcttcaatcaaaggccagatactcatacgacgatgactatcagtaatagattgaatctcagttttaagtttacgaaccagattaggattaccttcagcagcacgtaattctgcttctgcatcaatctgacgtaagcgagatttaatgtactgattaatttctgacgtcttacgaggaatattcacagcaatatccttaacaggaacaccacgcccaatcatctggtagatgttagcaaggaagttaactgccggtactacaacagatttaacaacaattactgtcttagcatccttcaccaagttctgaatggtattttcagcattcattactacatgatatgccttattaccaaatgcaccgaggaacatcttcttaacagtatcaagggtgctaggtgaccaacgagagttaccagtccatacatcaccaatagatgcagcacgatagccaagtgcatcattcagcatatccctacgaacccataactcatccttaccaaagagttcttcagccttacgacgagtctcaatgttcatcaggttaattgcatcagccagtactgggtcatcaattttacctaacaggtttacatattgagatttattagcactggagtctttaatgtctttctcatacatagcatgtaattgctcaatgagaatgtcattaaaacgttgtgctttagcctcttccacctggcgaccacgccatacacccaccatcttagcaaaatgattgtcttggtttagatgcttcaacatattagggtcaacggattgctcataagcaactacctgacctttgctgttataaattggcatcagtggttcacgcccacgttcacctttagccagagctttggtaatacgctctacggttggtttgtcagtaatacgaccagcaaccatagtacctaacgtaaagccagtaccaatatccaccccaccagcagtattacgaacattctgaagaataccctgagagtaaggagcacgagcagctactgggctgaagtaataacctttagaaccagtacggaaaccagtgcttccctgataagtaccaatacgagtaaaggattggctatttaacttagcaaactctttatcgtcagcaataatcaaattcacaccttgctggttctctacagggatatagcccttaaagtgattcagcagagtacgattatcacctttagctttacgcatctcttcagtacgttgacccaccatataagcaatggagaactccataccttccacttctgattgagccagttctgacaaaaggtcacggtcagacttattcatcaattccagagagtacaaagtaatgagcttatcaatagcagctacatctgccacaggtccattagtaatacgttcacctaacaaacgactaatagcatgagcattacgaaggaggttattacctacttcccctgtaatcatgtattgagccagttgcttagatttcttctgaaccaggttccagtttctacctgcttggttctgaatctctttttccagggtagaaatttcatctttcactttcttggatgaagagagtaaatctctaatttcagccatgctcatagtttcacgtagaacagctaaatctgttttacctaaaccagtatgcattgcagaccactcggtatcagtcagtttacgagagaacttaccagcaatgactgtaggtaaatgctcacggaattgttgacggtcttgagaaatctggctcttaaccaatttgattaagtcatagacattggcattagtcttagtacggccaacaatgtcattaactaagtcatggaaaggttgccatactttaccctggttcatagcagtcataacaccctgagccactatttcaccttgtttttcagatgcaatagcagcagtcagtttagccagatgagcaacacctttagcagctatattagaagggttagcaattaccttatctgccttctcaataacagtttcagataaccgttcaatgctatccgttacatactgattagcccggtcaatgaagttaccggtaggggttgctacagcatcatagaaggactctcgtttcagagcagcagccatgattgtttctgacaaagcatcaatactgtcttgaacattagtagctttctggtcaccagccatacgacggttcagagattccattacctgagtacctgcattggtaagcagagtatctacatcattccctaatttcttatctgctttaggtacaggcatttctttaatgattgaacgtagttcttcattaaccatagccagacccaggaatgtaggtaacagactggttctgcctttagcatctacttcaaccagattagcaccagagatagtgtcatatttctgttgagcatagtaacggtcagcaggattagtactatcagggtcagccatgaaatgttctatcgtaaggtgtttcattacatgagtataaagttcctgagcacgagccatagcatgtgggtcaattgcagcttcagttgctaatgcagcagtaaccatctggaatacagattgttcctgagcagtcatattgaagccacgagactgaacatcacgaaccagtcgagtagcactcattaatgcattagccacattgccacgacgttctacttctgtaactgggtcagtacgaaggtaatcggttaccagtttatcgaaggtctggttcaactgagacagacgttcattgttaccatatgctttgctatggaacagtgtgccatctttagctactgcctgagttgtaggttggctacgcatcagaattgcagagttaaacagcaaattagagaacatatcttctcccaatgcaggagcttgtttacgtccccaaatcaacttcttaatagcctgataaacatctttcaccatttgaaccagtgaagatgttctcttctgtttagcagcaagagcacggttagctaatccccaagccataaactcattaagagcagcagctttagaaatagctgggtcaacaaagccattactcaaatgaccttcaatagttgcaatagcatcagcatatgcttctctcatttctggagaatctttggaaatatccagagaacggaactgttccatcaaaccttcaaggttctcaatagcctgcttagaagtggggcttacttcattaccctggtagaaggaataaacctcctcgaaggtagaagcatgaaccagttcatgaatgagggtttccatagatgggctaaccagataaatggtcttatcatcgaagttagtccagccataaatattacctgcctgagcttcttccatttcctgagaagtcaattcagtaacattcttctgacgagcatactctgcaacctgagtaggtgtaccgtagataatcttatagtctttagctgccagtgatttctgaatctctgcaagagtagctgcctgagtagatggcagattactaatcttagccagattacgaatagcagtagcagacaggatacgaacaccggatgccttatgctcacggcctaccataccaaagtctggattcactggttctttttcagaaacagtttcttctttgacttcagccttagccttagcgactttttgtttacgggcttctaactcttcacggaaaagtttattcagttcatcagcctgttgttcaggagtcatattgctgaggtcaatcttaccgttgttctgataaggagcacctacagcagccatctggtcaatggacagatttaccttatctagtaccttatgacgaatatctacacccagtgcaatattacgtaagttacgttcaatcagagatgcagcattagcaatatcatctacagtagcattctcacgttggtcatattccagagcagatttaccaattgcttccaatgcttcaggggacaacttgctgaaatctacattcttcatgaacttagcatatgattcgtaaacatttttaatagggttaccctgccaagaagtgtaaacagcttcattagccttacgactagcatcagtgatgtcattcaaaccaatgttcataccatcaaagattttgagggtattttttggtgcacctttcatagtggaaagagtttgcatcatcatgccatcaccagtaccaatagtcataaatggaatacctgctacaccggcctgtgctggggcatagatactcattggtacacgcatacggtcatcaaggttagtagctaatacctgatttgctacttctgcattttctgaaccagcaatgtagaaagtctgagaaccagtctcaatcataggggctaagttattcagagaagcctgaatatcattcagttctttctgagtaaggaaatcacctttcttccatgttgtgtctttagccttctctgccagcttctcctgtactcgctgtttgaacatatcttccagcactacagattgaatctgagtagctttctgtaattgttcagtggagtacaccagactttcacctacagtctgagtaataccattacgtagtggttctacgaagaagtgcagcatattttcctgaagtgccttcagttgctcacccttaatggtataggtcttaggattgattttccctttggctccagcacctgtggattgcagttccagtacacctttacgcttaacaggaacagtagaagtcagtgtttccatatctttcaggaaacgggcaagaagttcttcagcatgtgcttctgaagcagcttgcttaccaaacattgccatagcagcagagatgtttgggtctttagcacgagctttcagcacatcagacatacgctcatagatggcatcggtaacagaactaaccagcttacctgcaataccacgagcacctgaaccatagatggtaatagtcagggggttcttagcaataccacgtttaagttctaaagcaccattctcgccaagattaatatccggtaagaacaaatccatcagagaaagaagactgtctatctgggactgaataggcatattagacgcgtagttactacgtaacttacccaacgattccatcaaagcattagtggatgcttgatataaatcattattgtcagcagtagaacgatgctcattcatggtcttatttgaagaaccaatgaacaagccccctttggcaatgttacgaatccagtcaggagtaaacagaccgcctgtcattagcatcatggcattgattggaccattagtaacaccatctgcttctacatacagtggagttacaaatgcagatttatcctctgctactaagtaacgggaatactccataagagccattaatgctacgaatgacttcctatctcctaatgctgtattcagaacatcaactgcattttctggtaaggaaccagtggtattaaactcaaccatcatatcaatggctggtttcagattaccttccagtaatttagttaactcatctgacataacctcacgagtcatagtatggactttaatgtccaatgcctgagccagacctaactggaatgcagagaagtcttcattgttctggttcgataaatccaaagtagctttagtaggtagtatagcctcacgaaccagtttggctgattgaggattgtatttacctaacatctgcatacgaccaacacgggtcatattgtatgcatagtgaataggcacagtagagatgtcctcactctgtgctcttacctgctcaatgacggagaacagttggttgtaagaatcctctactgaacggttcttaccttccagagatttagcatggttatcattaagtaactctttattcagagtaccagcacccatcagttcgagaatacggtctttacctaacgtttcatagaattgaaccattggagtgtgtacatagaactctgtagcctgctctgctttcaatgcagccttctgttctggagtattacgaacagcagggttacgaagctgagtattagctacaggaggaatgtcatcaccaaagaacatcttctctgtaggattcactaaaacagcttcttcaatagcagtagggaagctattaattgggtcgaaggaatccagttcagtaatggtgtacagaccaatagtcttcttattatctgggtcaatttctgacatatccacgatgttctctacaacatccgtagactctacaaatgcagccagaatttcagcagccattgctgtagggatgcctttggtatagcccaatggagcatttggattacgagataatccccagtaagactcaattttctgagccagggaactaactgcttcggtgagtgtcataccagtatcaaattgctctactaaaccttctggcagcagagcttggtcaataccagtaatagcagcaacatcttttgcatctttgatagcagtattgctggtagcagtaagtctccactgaagacctgctaatacagcagtctgtagcaattgctcgttgtacttaaaggtatccccatcctgttcaacgatgttaagtaacttaccacctacccaacggttggcttctgtaccctgagcaaaacgtttaccaacatccttagtgttaaggaacttagccagacgggaacgaagaatatcagcaataccttccccatgttccatgagttctttgtatcgcttaataacttctccattaaaagcaggattagcaacatctttctcagtaaagagttcataacgagcacgggaagatagagcttgagctacatcttttagaggtgcttctgaaccaacagtacgggatttctgttcttccggtaaggtaaaggacaatttgaaatagttcttaataccctctgctttagaatcagcagtacccaccaatgaagggtaaacagcatcaataccttctcttaattcttctgtaactgtactttcttttgtagaagtttcagtttctttaacagattcagtaggttgcttgatgttgtcctcattagtaaggttaacatcctgtttttcagactggctcacaggttcttttatagcctgtggtctagactctttagtagtaggttctgttttaacaggttcactaacaggagtcttagtctgtacagtagatgtaactggttcctgttttgtaacaggagtttctttaacctgattcacggagtcagctttcggttgagaagaagcaacgtctcgattgccttgacggaatgccttgaccacctcagcagcaggagcgttaagacgtgaatccaatggagtaacttttatatgactgaccttcagttccgggtaagccgaagcgagggcattagcaatatccgctaccgttttcgcttcaagagcaacttgctgggcaaatttaaccgacttagtgtcatagggattgacccccaatccggtacggctacgaacccattctctgtcagcagtaagagcttggtagtggacagacttattcttatccgcattccccgtaacaagatgctcattcaacgctccaaccttattctgcatgtgctgggcgaactgcataaagtcgttcaggtaagcggaggccaactcgaaattaccagagttatacgcagaccgaatcctattcgcatgttgcaacgcagagtattgtccttcctgagttctgctctcatccgttttaatctgtttactcacaatgtcttgaggacgtaatccaagacgggcagcttctgcatcatattcccgtgcccccttcaggattgcagcagcattctgaagggcagcaatttggcgattattcagtttaatacgaccatcagcagcatgtttaagaacaacatttacagattctggattgagcttttcaggagctacttcagcagctaatgctacgttctgcatttcctgtggactggattcttcagtcacatccaaagaaccattctgggcagattcattaatcattcgattaatgacattcagtgcaccaattacttttggtgtgttctgaatattagctgtcagatttgtataacgattgagtaactcaatagccggagaatctttaggaatgctatccagtgcagcagggtcacggttaatgaattgctcaaactctgaaacagcatcatacatataagatgcagcttccatcagtgcttgaggattagattcatctaatgtgttaactaggtctgctaacttttgaataacctgtacttggtcagtagaaccagctacagcattacgaatatgctctggtgcttcctgataattttcaggattaaaacgagtagcattcattaagtcagaaacatactggtgtgctgcaactttctgttccggagtagcatcagttgcttcaacagcatcacgaatagtaacttctgcttctggtgcttgagccatagcttcttgtgctgcctgtgcaacatagtcatcagcaacaggagatgcttcttcattttgcttcataacccgctcaccacgagctaccaaagtgttcttaataggggaaacaaccttacctgctacactaccagcagctttaacaccagccattgtggtacgcaatataggagcagttgcagcacctgctaaacgagcagcaccagccggagcctgtacaacaccagcagaaccaaagccataaagagcacctaaaccagcttgtgtaccgacacctttaagcaggtcttggttcttatcaatgttttgttgctgtgcaatattctgagccagttggcctgtagcaccctgaacaccttcttccactgtttcacgggcaaggttcatacctacagcacctaaagaaccagcacggaaaggggccatctcaaaacgagataccagaggaccagttgcagcagcaataggtaattgaatagcagcagcagtaagaccagtttcagatgcagtctgacgacgagcctgttctggagacataccctctttaatatgttgctgataaacaggagacttctctaagtctttaagactcatcttcataatttcatcagcagtttgttggtatgcaccaccagcttccattgcaccaacaccaaccatacccggtgcagctctacctacagtagaggcaatacgagccagtgactgagtaccagtacctgcatcaatagcaccagccaatgcagcactacgaagagtatttgctggaacaactgctttacccagtaaagatgcaccccttaatacaggaccagcacctaatagagaacctaccccttctgctaacccatcggaaataatggagtcagtttgagcagcattctcaattgaacctacaaaatcacgtccaaatttagataaggaagctactatgtcattagtgccttctttcttatctgtttgatactgacgttcactctctacttcattcattaagttacgagcagcaaagagcttacgtttatcttgtaatgcctggctttgggtagcatgaacagcatcattaaacttactcaattgttgagcaacaacagcacctgcatcatcgttgagtaagcctgccccaagagcaccaatgcccccaagggtattaacaaaaccaagaccaacaccagtagcaatatcacccagttcttccccaggagttcttgtagtaactgaatcattgaatacctggttccctgcatcagcacgagcgttgataagttgtaagccttgctcaaccccatacttattcatgatttgcattggagtcagattcatgaaatctgattgcactgtccctggttcaaatgcattagccccaacattaccagtacgggcagcttgcatttgataagcagcatcaggagaaacaagaggagtagtgacaccttgttcagctttcttctgggcggttgcagtagagacgtcaacttgctttgcattggttacgctgtctgcgaacccagccagtctatcaaatactgacatagtaggtttcctatacaaacttatatctattagaaatcacactatacctagtgtaaggacgagaaaaaagccccgaagggcttttgtattatggtagaaattaacgaggaaatatatcagggatacccaatcgacgtccggcatctctgcctaaacttctccggtttgcctcgctttcttcctgtttaatattttgtaggctcttaatatccaaattctgagggtcagcagctacagcactacgagcaccatcaagaagacgtttagcagtattaactcgctcctgatagcgaggtagtacacttctaaggttttcctgaccggtctgaatacgacgctgtacttcacgtaaatcagcaagtgcagtatctaacgtattctgtgctgcatagatgtttgattgaatttgtgcagtaagctgattacgagcattctgttcaatagcagtaccagtagttgcaagttttgcatttgcctctacggcttctttatccagttggtaatcaccacccaaatcaataacatcagtatcaaaggcattccgaataccactaaaccatccctctggtttaccagtgatactacgttgaatgattgcccctgccatagcgggagaaatagcattctgttttgctacctcattgatttgtcgaaccagtgcaccttgattaatgcctttcagttcattgctatcaataatacgtttagccacctgaccagtcgtagaagggtcaacagtagcagcttggtattcaggcagcagagtattaccaatattctgcatattacgagtaccaacagtattaccagcaacagaagtgaatgcttgttcctgtaatggattaatagaattacctgtttctgcttgagcaatgtaatccttcatttcatcccatgacaagttcttataagcaccaggagtatcatccggtaaagcagcccatgtactcttcagattgccattcttacgagcattaaaaatagcttcacccagtttgtcttggttctccggagacataggaatgttctgccaatcttcaccaaatacctttggagcaaagtctttaagggtatcttggttaatctggtatgcaccaacaggagaagcacctagtgtcttcttcatagtgtcttgatgctgaaccacctcacctaagttcatctgagtaataggtacatcagttggtgtgaacttataggtagtgtcatatgcagaaccattccgagtaccctgagtaccaggaggggatagagatgcagaaccagttcccggagtatatgcacctgggtatgctctatctaactgagataatgcacgacttactgcccctggtgacatttggtcgaatgtaccctctgcaagcatacgagcatcgtcagcactatatgcaccacgacgaatattattcagtaactgcatagcagcctgagtatccgcatcgttacgcatatcaacacctaagttgaataagctacgacgttgaccgataccagcagtaccttgtccttgaaggttgttcatgtagtccataacaacaccagcaggaagggtttttaatatatccccatactgagcctgtgctgcctgaacctttcttgggtcaccagattgataagccagagccagttcctgcaatgcaggggcagcagcatcagtagctgcatttaccttcatggttctgtcattactgtatcgagtgaaatccagattttgttgtttagatgcttggtctaacagattgccagcacgattatctaagttctccatagtacgagaagaaattagagaagggtcatagccagcaaataatgctccagaagctaaggcattacgatactcattagggtcttggtaacgcatggcttcagccataattgcatcaccagcttgctgtcttgcagagtttcgaaaatcacctaatgcattacccaatccggcagtggcattacccagcatattggagaaagtacgaatactatccccaacaccagagaaagaaggagcatcaacattacgccatgtaatttgagccatgtaatacctcttaacgagttaagcgattggctgcaatgtaagcatcagccgtagattggtcacgattttctgcaacagcacgactacgagcacggtcttccagagcagtgttataggacttaatctggttattcagattagtgttagtaacatctttagcaaaagagaactgattcttagctaacttgttagcctgtaatgcaccataaatattacccagtgcattaagaccacctaaccccaactggaaggtaggaatgttcagacccagttggtcagtaagcccttgagtctgcccaccggtattccctgtagcaccaccagtaatattctgaagccagtcattactaaggatgccagattgcatagggttatagttcatggttggggtattaaaggaaccatacccatagccaaaattgctttgtgcagatggggttccaaaaaggaaattagtatccataaggattctcctgttacgtatctaaatcaagctgcaacgttatatctgcaaagttggtaatcatgttgttagacatgtcagctatatcatgaccagtcataagagtacggctaaggaatgaatccaatggttcaaattgttggcctacattagttaggttcattgggtcaatgtaacccatgccctcagtaccaaacatttcctcgtacttttcctgaatggttttcatctggtcacggtactctgccataagtttctctgtctttttgacagtttccatagcagaagcattgatgtaatcacttatgccattccctacagatgaagtgagtttaatgatgttgtctgctttcatcatttcacccagcatcgtagacatggatgaaccagtggataaagctgtaccaacattcatggctaccatagaggcaatagtagcaacaatgattccaatcttatccccaagcagactaacagagactgtttgaataatggacatcagaatcatagctgcaatggcattagccacagccccaacgataatagcagctaaccctgcaaaacctaatgcagcaccaatagaagcagcagtacccattaccccagcaccagcagcaggggtaaagaacacagacaccactactgcaacaacaaccactactactttaaagatgccagactgataccatttcttcttaactttcttatatgagttaagaaccagataacaacatgctgtagataactgagtaccatttaccaaagacatactacgataaatgttgttatgaagggggatgataaatccagactcttcatcatcatttagtgcatctacaccagaaatgcttacagatttattcttgtaaacattattgttatggttcaggccatagacagaaatcttcctccatgagttatccccatcctgccaatacattgttatcttatctagcctgtagatagtaaacccaactttgtcattacccttttcagagtacataacagctttctgcataaggactacagtaccttcataagcaaacttgagctgccctttcttggctccagagaatgcttttcccgaaccaactgactcttcaatgaagttccaactaatagtcatgttgtaacggtatccaccgttagaacgaatattaatggatttagaaggtattgttggatatacgggtcttttaggaggcttccctatgggaatatccctattaccactgcgagatttccaccattcctggtaagcatcaaagtccctgttagcctgagcaaagccttctaccaaagcatccatagttgggtagtttgggtcagcaggcattgactgattcactaactggaagaatctgtatatgtactctttagctgtattttcaggactattaagagaacaaccgaatacagcatagatatactgaatatcaccaatatctttgttcttcttcaggtcatccataatgtcagaaatcttaccccctgtagccttcttaaaagctctcttacaaagagtatacgtagagccagaaatccagttcttatcactacggatagggataaatgaatagaatctgttattggtcgtcttattaataaacagagcatcaaggatggcattaccactgttctgtttataaataaacaattgaggcataccaccagcagacatagtagtaactacatctgtattctggtaagaccatgtataacctaaagtatcagtagttactgtagtagttctggtttcagtaaccccaccacctaaatcaataacttcggtgtttgtagtggaaccagtggatacagtgccagtctgtacctgggtcattgtagtcttacgaataatgattaagcctacttcacttggttcacgaaattctttctcgtaaacatctgagaagttagtccaactaacctgttcttcttcagtattggtactttcctcatcaggtctaccatcagagaatacactcttaatatgagtaactgtcttcagggtagctgacttaggagtatggttctgagatacctgagtccattcagaagtagaaggtaagtcatcagcagatgatacaaatacagcagggtgaaccactgggtctgcaacactagtaggctgtatgtagtaatagttcacatacaggtacattgcatcctgactgaaattctctggataaaaagataactcactaccatcagtagcagtaagtacaatcctgtcatcatccatgatgtctatttcaaactcttcagtaatacggtctggatagttctcatagaggaatttatcagcccattcctcaaaatcaccgaatccaatcctactgctctgaacctgtacctcataacctgctttttgaggaacctgccatttaactacttcagggtctacctgagacagtattgacaagttcccataagcaataccaattgaagggtcatagttagttgcagcccaaccagggaatctacgtaaacgaataccaggtccatttaaataagagtcagtgatggtatcacccatactaaagtcggatttactgacgatgttaccaatcactgtagtctttaaataatttggacgtttatgtatatcccctgccaaattgtagacagaggatgctacgtagattttagtcttactgctaaacagtcccatgtattaccccaatgcgttgttattcttcaatgcagtaagaatgctatccagactggagttagtgaagccattaggaggagacagaccctcatcaatggttttctgagtgacccatgcatcagtaaacagtttggcagctttaacttcagcatcacgtttataagacgtaatctgttggtcatagagttctttctgtttacctacagaaccagctacacgagtaccatcagtacgagtatcagaagtctgggcacgttgtgcttccttctgctctttcgtcatattgatttgttcagtagttaacttagtctgttcagcaacctgagtagtctggttcttcaacatcagtaattgttgaggaagcatagaggacagattgtattgagcagtacagtaagttactgactcattagacagcttcagtttagtaagagcatattcagctttagtagccagagcctgaatcttagctgtaacaaagttagctttgataataccaagattagcacgagcagtaattgcagctacctgagcagtaacagcattccaataagcctggtctttagtggtaaggaattgcacagcattagccatacatgcttccatagtagcaatgtatgccttaacgtaatcaccacctgtgattcggttattcttaaattctgccagtagatgattgcttgctgattgcattaaagcatcaaatacacctgaaccaccaacctcacgagtagttagttgttctgtggttatcttctctatctctgcatagatagggctattaatgccaccaggaatatcatactcactgccagacatgtcgatgtcaggaagcgtaaaatcctcacctgctacaagagcagtaagtagagcattagcttcgagttcagcaccacatgacatggtatttcctcattggttcattaaaagaaaacggctcacggttttacccagtgagccgtgctgacttacagattaactcttattgagagtctacgctaccagcagcaatctgagcagcagccagagtttgtaattcttccttagtcagtggaggcagaacttcaatggcaaactcacgtacccatgcagacgtaatattaggctgaccattcttacctttggtgactcgaatgttcaggaacttacgttctttgaggaagttataaatacagtaagggatgtgatagccctcatcagtagcttcaccaaatggaacgaatttacggacagtaccaatatattcgttagctactgtaataatctcaccaggcaggtctttcttcttagggtcaaggttctgaatacgtactcgaaccagctttaattgttctaagcgttgctggtgacgtaaagaagttgccgtagttactgtacctgtagacagagccagaggattaggctgaggttctactggttcctgagctttattttcctgtgctgcttcaatcttcttacgaagagtttcagcactaatattatttgagtatgaaatacccatcatattagctcgttgtttcagcagagaaagttcatcaaccttaacttcatcaacggtgtcatcgttgccctgagttaaatcagcggtcggtttatcgttaatgctcatgtgtatatatcctattcataaagtaaggggaggtttccctccccctgatgttagcccaactattatagcggagctacagttttaataagagccagacgttctgggcgtttaaccagaataccgtagtaccatttgatgctggagaagccagtttcaccatatgggtcattacggtcagcagtttctttaccaggcatcttagtcataacggtaaatttaagtgacttaccgtcagtctggaagccaatggaggtaaaggaatcatcacctactaccagcattgggtaaacgtcatagtgctcttgaccagataccatagaggtacggtaaccagggttagctccagtagcctgtgcaccagcacctgcccagtgcagcatttctggaacctgaatgatacggaacttatcaatagaaccgacttcaccattcatgatagtacctgcatcagcatagtgctgagtttcgataaaggctttattaccgaacaggtctttcattgctttcagttccggaaccagttcagaacctacatacataacacgagtagcaccgatgactttagtatcaatcatacgggaaccagtgatgatagtggtctgagtaggagtacggttctctgtcagaatctggtcaagacgcatcaggttcttataagaaacgatagacggagtagaaccttcaccagtgatggtggcatcagaagtagcagcaccagcatacagaacagtaccagcagcagccagcaggtctttttgcagtacagcttcagtaatctgagtagcaccattcatcagttcacgggacaggtgttccatcaggccatcatcagaatcgaagtcaatagattcctgagtgaactcatagaagaagccaaacttgtgaatagaaccttcacgagcaatacgagtaaaaccaacacggttaactcgaccaccgttttcagtcagtagaggcagtttggaagtaatgttaccgatgtctttgctggaaccatacaggttaccattaacgatagtagcaccacttgcatcaataccctggtcattgatgttacggtcatccagcagaggaacatattcatataccttgatggtcttaccgtaatgcttcggcatgttagttacagaggccagtggcatgaagtactgctctttacgggcagtgatgattgctttcttcagccagaagaaggtttgcatctggtcagagttagcaccatcaatactagatttctgaccgtcaataggagcgttatagttcaacatgtctcaattccttataggccgttcagccgaggtagtttcataaagtcctcgtcactcattgcaagaggattaacaaggacttctgtcttacgcggtgtaacccgtgatggggatgccgctgctgcctgttgagtattagtgatttcagacttaggagttgcaacacgagttgctactggctgaaccactggtttaggttgttcaacaggtttctgcttaatcaaatcattaaaaccaccattagcagcaaggtagttaccaacttgattataggcatccaggaatgctgtaccgattgggatttggcctaagattttgagtcgttcaatttcagaaacaatacggtcgtaaataccgttagctttctgttcaacgatggtattaaccagaccacggttttccagcaatgcctgtttgctgtggtcatcccacgtagtcgaaattaactgaagagtagcttgtccttctggagtggatttagcatcttccagttcggttgcaaatgctgcttcagcatctgacacacggtgattaccagcttggtatttaacttcctcttctggattaatatccagaacatcaataccagattctttaatcaacttcttaatagcatcaggattccctttaactaaatcgatagcataagagagttgcccttcatctaataatccgttgttttctaacatcaggagatacttacgatacggctgaatctcctgcattttacgggtatagttagctcccatttgcatcaggctaatgacctcttcaggactctgaggagtaatcattttgccgttagctttaaacggagccattatccgttcataaccagccttatagtcgaagtcagttttctggtctgatacctgcttgtcttcttctacttttgcttggccttgctcagtagtagaaggtgcattatcagtagcaggcttactgttgctgtcaaccttatttgggtcaactgtagcactatcattaccagttgtgaatgcatctgaattgctttctgattcagaagtattttctacttcagttggttcagtagttacttctggttcatcagtttgttcaacttcaacaattgggtctggttgtgcaggagtattattttctaccggttccgggttgttctgaatgcttgatggaccaggcatgttcagaatctcttcatccgacattttaaaaatgtcggaagctgtttttgcagcttccgtagtcatgggagtatctccgagttaggattaattaaacttcttcaggttcaccacgagcaacatccaatgcattctcaatatctgattggacacctaccagtgtttctgctttctgaagagtaatttccagataacgttttaaacaaccagcagcttgagccatagcaagagcatcagcacgttgacggtcttcaagcaatgggtcacaggattcttgtacataacgagcacagtctacagtacagaattgctcaagaattactttacggaaaagggaattacccatcagcttacgaacatcttctgcataagcacgagcagctttaatacccttcagttggtgttccagtccttcaatttctttttctttgctatacataattaattacctaatctaattcctgggttaagagctgggtcacgggttgggtcaaactgactggaaccaagtgaataagcagggttggcttcagcagctatatcccgttcagatacagattgaatacctgtatcctccccattagtcaatgcattatacccaattgcagcagataagttagggggaagttctccttccttacgtggcttggttaatgctttagtaatttctaattgctgattaccttgtgattgagctttcatcttctcaaggtcacgagcatgtttagtgccagattcttgttccagataatccagattcttattgtctcgttctgccatagctttttgagcttgtgcatcattaagacgaattttagaacgtaactcttcattctcaagctgtgctttctcaacagccaattgtttgagttgttcctgtactgggtctggttgaggttgccatgtacgtaaatcatgagccagtttaggcatacgtttcaagtcagcaatctctgcaagaatattcaaagtgatttgctggtctacgtttggaccaatagtctgaagcataaagcctaagtcttgggacttttggttgtctacttcagcagtagaaatatctacttcaaggtcaaagttacctttcaggtcttcacgtttaatagtgacaaattcttcattggtaatacgcactacttcatgctctgccaaaaacacagcattcatagcaataatcttattaccaatttcagacatgcctttagctaaacgacgaaggatagccatctcacgtttagaagcagcatccaatacaccacgaataccggcagctacatcaccataagactcaccagttaccccaccagcaaatgctttaacaccagtaagagattctgcttcctggttctgaagggtagccatagtcagtgctgattgtggcaattcagggaacttatgctcaataatcatttgagcagggttttgtgtaggattgtattcataatcctcaccttccctgtaacgacgactattcagggcatcaagcatacctttaggcataccacgttgaccattggcactacgtccaagtaagtcaatcatcccacgcattacagcaccaagtactgcttggttatcacctaataactctgcatctggttcgccatacatatcccgtttaacaggcatatatggaattaatacaaatgggagtttgccgtcaggataaggattcttctctaaacgaataagagtagaaccaatccaagtagcaacaataggctctaatacaccattcccttcaatatcccagaatccccaatattcataagcaactacacgcttacgcatagggtcactaatctgaaattcttgaggagtagtagttgcatggtctggctcattaacaggagcagagctttgccaatcaatcttatttagattgtggtaacggtctttctctttaagcaggtctgccttacaagtttcaaaagagacaatggcaaacattgccttattaatatcaccctgacatgaggggtcgataataatgttctctgggtttagcatttccaccgtaggatggtttgctaaaggaacttcaacttcagttgtagttgtcccagtttgtactgcatacgttgcttgccctgtttcatcaaagaaacgtactgattccttaatagcttcatccacattctcttcatacccacgagggttgtctgtacgaagttgtagagcttgttgtaaagcatcagcttgttcttgtgtttgaatagggaacaaactaaatacaggaacttcttgcttctctttacgaatttccctgttccaaccaacacgaacaataccagtaccatcatcaacaactgaacgaacatagttatcaatgaaacttacacgattcagtttggtacggaattggtagttaagaaccagttcattctggcgtgcaccttgtacatcttcccaagttacaggagtaactttgaataacttattagaaccaaggaaaggttcagttaaagcagaataacgccattcagcttgacgacgtacaagtttaggctgtacctgtgaacgtcctttgactttaggtggcttggctttgccttcaatacgcataaggtcattccattctttgaccttaatcatcatggcagtatgagatggctttgctgcatccaagtctgctttaagtgcttgtaaggaaggttcattcttccagctagttagcttagtagcttggcttgggtctggcaatggaaccatagaatcagtgttttgttccatagtaattcctattcaaacagtttacggtcagaacgaatctggttccccagttcaatcagttggttatcacggagtctaacagttgccctgagttcttcaaccaaacgtctgccttcttcaagacttgagtcgagtctggctgcatggcttgcaagattgaggcattgagtggttccggttgaggcttgacgtttataactctcggctcgtttttctgactggagcaaccgactattgtactggttagtaatagaatcaataacgacttcataagactctttggctttatcaagtcgaagggtaagttgcccgacttcataactgtgttcccgattcttttggtcataagccagttttactctatcaagttcttttgagtactccttcttatcttcatcccatagtgcttgaactttcttttcaccatgttgtgaaccaagaagaaaaagggtagctcccagagctacccctcccaaaagacatacagttaacttaattaacgatgtcttcattacacctctccagagggacattaccaatacgattagcaatccatcctgtagtgtactcaggcatattaagagataaatagtagtttaactgtttaccatccagagacttcaaaatgagcttacaggcttctactttgcctcgtttattctgaaggctcttatatgcacttagagttccagaaccgactttaccatcaacttgtattttagggtagtctttgccatttctggaaaaagcattaagagattcttgtaaccaacgggatggtcttgcaggtccagtattaacaccagcatctactagtttttctgttaccgctggtgatacatctgcaaacttaacaaagccaggcttcaagatgtaatcgttgtaataaatacttgatgccatttcctgagttaagttcttcattgaaccatcccagttatacaccgactctagttcttgcttatgcttttgagcaacctgaatagttacaccatgattagtttcacctcctgggtctttggggtcattaacgtatccaccctcaacagcaaatacagcagcaatgattgctgcaataacccccccaacaccaccaaccttcttcttacttattgccacatcaatcctcctttggtttcaaacgaaccagtcggcaaataatattcagcacaaagagtgctatagcaatgttattgccatgtggaatatctttgaggatatgttggggtaatgcagagaaagaactggataagacatccacacaagagaagaacaatattgctaatgtgctaatctgaatagatgcccatttccaacaacgtttccaattaggaaccatttctacatgtttggttaacttgcgaaccatgcaaaaatctcccgtctggcagcagccagtataccaataatgatacctgctccagcccatacccatttaccaaacaatccagcaccaacaactttatgtttaatggtaatgaactcttcaatagtaggggcagactcagccagagacttttctacattctctagtcgagtgtccatcttattaatagacagttgaaggttacgtacagcatcatctaaatcttgccgagatttagcatcacgggcattattttcgaagagtgtcttcatacgttcctccattcgagctaggagcacctctacggattcatgactcatgctaaatccttattgaaaaagccaggtatccccggctctgttagtcctaatgaacagagagtgtgtttatacacccgtcaaatagtaccgatatttactagtatcatccacatactttaggtacggcataaattacaccatccctcattacttgcgtgtatgaccacgggtagatatgtgggatacccgcctctagtgccaatccccaagccttatcaacatcagcccagattttcttagcatcttcaggtaacagtacgaatcctatgaagtaatgaactacattcaatggataccctagtctattcacagcagcatcaaatgtcagtggaaccaggtcaagtcttccatcgataatccagtcatagtcttcaatctgaacaaagtcatagttaggaaatatccattctgactcagggaagtttaatcgacctgttagttcagatgcaggggacataatctgtggtgtaaagaacagaagagttgcctgtgcatcagggaacttaccttttacatagtcacgtatatagttagtggattgacccagtttggtacatagccaatctacataaggccattgatgttcttctactggagcaaagatgtctttaatccatggagtaggtacatcattacctgtctcttctttgtataaagccatagtcttagggtcataaatacaaggagcattcttaccttcacctgtattgtatgaaccatcccaccaccaaggctcaccaatctggaagtacagctccattcccaagttctgacattctttcaaaatctgacattgagctttacttacaaaatccagagcatctttgttagtaggctgaataaaactagatggtggataccaaccggaaagtgctgggtcacccttccagttaagctgtttccactcgtcaggcataaagaagttaagaatttcataagcaacagagttaacaaacttcatatcccgttcatgtaataaagacaggaatcgtttataaaactccatagtaggcatgttaataggctctggttcagacactgggtctaatcccaaacgcccaacaaaccaataatcatcatgctgtttcttaacaggacttactaatgggtaaacaggaaccagtctgagaacagacttagcaaggtctaaacaaacctttctggaagtctcaacattgaaatgaatctgtcctattcctggttcgaaggtaaagtcatccggcatgtactgtgccgtcaatgctcccatatgaacatcagtcatctcattaataagttgtgattgaatctccctaatctgctcccgtgggacagttgtaggggaataaggaatcggtactactgctgcattactcataatttaatacccccattgctgggggttccttgttaaagagtggctgtcatatcaaattgtttagctacgttagatgccccatctgcacgataaggtcttactctccaaaccatatggtcagtcaggtaaccgtactcggctgtaatttcttcagccgtccaagtgattgtaggtgctacaacaatctctgttttaacaacagtagagttctcagcattaagaatctcaacctgccattggacagcatcacctacttcccatgacatagtacagttacctacagagtctttcttagcaaagccctgtccaactgttcctgctgtttccggtacagcaacatactcagtagtaagacccaatgcacctgattcaatatcatgttcttgagcacgaacagatatgcttgaagcagtaaagccataagcagctacctgttcttctcgtgtgaacacaagattgttatcagatacaaactggtcactaatagttgcattggacgttacatgcatatttcgaatacgaacatcacgtccaccaacagaaggtttattccacataatcttaatattagagttacctgggtcaccggtgaacactgcatacaatccagcaacaggattcattggattagacggctgctctgcttgaccagtaacttgagcaccaatagatactaatccgttacttgggtcatactcagataccatgaagatgacatgagtagcaccaccttcttccaggccgtagaactcgttctgttctgcaacagtccatgttagagattcactagaccattctttagaaaagataacagtcttagaatcattaacactggtattcactatccagaagtgttgccatgaaggacgccctacccaagtgaagataatgtcaccattaagctgtttagcagctttcagttgagtaggagtctgcatataggaaccattctggactacccctacaaaggaagaagatgcacctactgcaccagaatcagcagcatattcagaaacagagaaactcatattaagagtgtccccattataagcattttgctggtcattcagggtaaacacatactcaggactggtgaggataccagaagagatttctgcccctgtggtgacatgacggttagcatacttccagtgggtaatcccagtacggttatcccatgtcatcttaatatcacgagtagccaacttacgaccttgcagatttgctggtgggcgtaagtaagaccaatcaggtggattagtagcacggttaatattaagagccagtgcttcacctaactcaatggctgtggcatggaatgcttctaccgtgtaataaatccaactggattccacattacggtacgcagtgtacaggttagaaccaggaacaaaggaacccagtttaaagcctatattagctgtagccatctgaatctgtttatcacgtacagtaacagtagcttgagagttaaggtcattaggaggagcaacaccaaaccaaacagtagtagccccttggaaccaaatctccagattagggttaccccagttggttctcatccatgcaagcattgctttgttagacgattcaaaagcagtcattaaagcaggccatgtagaagaattaacatccttcatatacatggtttcccacggattagcttcaatgaagtaatcaggtttaacacccaaacctttaaccatatcgttaatagccagtagtgcatcacctggggaattactggaagtattccaccatttgtgagtacctactgtcatacctgcactatcagcagctacgttaataggcattacctgaataggacgtaatccagctttctctgcaaaagtcagacgtagcgtagaagcagatactttgtctttacggccaattgcaccattagctgtggtagcagttgggtcagacatatcagtaaagtgtccaccaccaaactggttaatacctaccagaatggtcttcttaacaagccctgcattatccaaaggaatgttatctgaccaaggtgctgaaggaatttccttttcctggtacagacaaactactctccacttcatgaactcccacggattaggagaaccaaccgcttccatcattacaggaatccagtcttctacagtgaagtcagcatatacataaccatttgcttcttgagtacctgatactacaaatgagtgaagtatctggttcaaattagaagggttatagatttcaatacgatactgagctaatgcagggtctaatccgtaagacttccaacggaactcaatatctccccatgtattacgacgggctgccaggaaagaaggtaaccctgtacgaataggtacattaggttcatcagtgttagtgatgccccatgcataactcaattcctgaatgaaaataggaatctgtccatacaaactacgaagatactcaaataccttcttagtagcttgcttggttctggttaatgatggtgctgggtcacggtcacctggatatgccaaagcagtggcatcttggtcaccttgcccccaaataatagctttaggcttgagcttacctacttgctctacacaatatagtaatgcaggaccgggtttatctgcttctaaatcccaccaccaaagaccacctgcaccggatgattgggtagggtcaaatacttcagaatcaggattaactgcacatgcacggtctacagcagtagaaccagttgtcccattaatagggcgtacacctgcatagttaatgccccaagtttcagtcatgtacttctggaatacatcatagccacggtcagggtatgcaccaaacatgaagtgaatagcaacctgagattcaccagcaaatagaattgggtaatctaatacagtctgttctgtgattaactcacccgtttctttatcctgaaatgcagtaagacccttccagtagtgggacatgccaatataagtagtccaccagtcacggtatcctaagccataggccatctttacctgacgctcaggagtaaggttatagccatcatcaaagcctgaagtcatgcccatacccatcactacttgtggatatttacgttgacccagttgcttacgaccggaaccagatacagtaaggttagtaaaccatttaacagagtctacttgtttaataggaccatctgtctgtaagtatttaccatagaatgcatcacatcctatgaacttacctgggagcatacctttgcatttaacagagaagttagaagtaccaaagccttcataacttactacttcgaactcattctctgctgcttgagcattaccattaacatccaagtatctccagatgcattggagtttatccccagcagctaaagcagcattagtatgaatacccccaatttccatctggaaagtagcaccatcgtcattgttatacatggcggcaatgtaagcatctttccctaggccatgatgtgcttcagtacagtcgaaagaaatcattgtgatattacgagggttaatagttaccccattaaatgccacacctgtacgtaaatcagcaaagtccagaatgaagatatagtccttagtgccatagacttctgtcatttcagattcaggaatatcttcatcagtagctacaaagatgtcagcctgatacgttctcttggttccatactttgtatccaaacactcccatcgacgggttttattattgaatccatatggagccagacgatacgtatatgctttttcaggagtctgaatagtaactgtgaatttatctggttcatcggggttatgacgaaaagccagaatcagacctaagtaattagggtctgtttcataacgatacaggtgatggtcaaaggtatcctccgtcatccaacggacacctaagaagtctttgttagtacgccactgacaaggaactttgaaagacttagaaccatacggaatgatggtggctaccattaaggcattgtaatcaactacccaatactcagggtcgaaacgatttagtttagtgttataagttcgattacgacgagtgttgaccaacgtcagatgttccctgtctttcttaaattgagggaggtcttctctccaagaagagtgctggtcatccgggtcataattaggagaagctaggcaattcttgcctttgaggtaatcttcaatggacataactgctccagtaataaggccggtttcccggcctagtttctttaagcgttggagttaataccaacaacggaaataccttccgtggtgttaaattcactgaatttaacctgaacacgaccgacatctacgattagagaaccataaggtactttatagattccgtgcataccacgagagtacatgatacccataccttccaatggggcatcaagtaaagaaccatctggtttagcaatcttcaatacgaaggaactatcagtatgactcttcagttgtgctgtaagctgagtaccatcggtaggtaacagtaagctaaatgtaacagtagaatctttgataagagtactgtgatataccgttaactcaccagatgctgtatcgaatgcacaataagtacccgaatcccaatcagatacagcagcccagccaccacctgaatatttcagttgtgcttctgcttcaccaaccataaccagtacagcagcccctgccgtaacactggagaatcgtggggtcagtggagccttgcctgtaggggtaatgaaagtcatcactggttctacagtctgaagactaggtggatacccaagagtgataccaccatatgcatctacattcagagtcactgcactggaaggcatgatacgagtattcacaccggagattgctttagcagttaggtctgctttaaaacggagtggggcagtaacagatacagtagctgtattgttagtagtagatgcacccataatcaggccatccaatgccatttgttgactaggtgctaccaacaagccactaactttaccggctttataattaagaaccaggttagctactgcaccagcagtaggggcattcatgttgatggaaccagtagctaacgaccatactccacgagcagaagtcagtttaccagctatagcataaccacctttgtcattacccatagtaatgacctgacgaagcattgcacctactgtattagctgcgtaagtctgtgcctgattaaagccaatcagacctgcaccctcagcagtagcatacttttcatggtcagcaatgattgtatcaagctgttctgcaatggtaactaagtcacctaacctggcatgtacagccagtagttcagtcatgtgattatccaaatcaagcaatgctgccatattggtattcacattcttaatcgtattgatattagtacttactgtattaacagcatcaatggaaccagcaacggtattcacattggtaatgctattagcaacagtaattactttatcaatttgagcagaaacaataattaccttagcaatatcagttgctactgtattaactgcgtcaatattagaagctacagtattgattggggtcaggttgtcatagaccctcagcaatgcctgaagattgtcatatagaccagtcagtttagataattgattgtagagttcctgtaacttatctaaattattatggataagttgtagttcatctagcttagtgtagatagcagatagctcagttaacttgttatggatagcaagtagctgagtcatattatcactgacatttttaataaaggtcattcgtaatgctacgaacttaacaacgtagtaagcgttaccaatcatcttatcaacgattgggtcattaagtgtttcgcagcaataaccttcgttggggatagtattaaacggggtatgaccactcatcgccagcctctctttctgaacaaggtatttgtatcaacttctgtatcactagtgaggtcatattcaacaacctccctacagatgctgtcataaaaggacagatactctgctgcctttgctgaactctctggggtattcagagaagtgtaataacggtaagcaatgtaggcatccaaagctgggtcaagggtatcaggaatgtctatctcattatagccatcctctgctgtagacagtttaggatgtttagcctgatacattacgttcaatacttcccatgcttttggagcattgttctgtagaacgtttggccttggggtgaacaaactgtgaggattatttcggtcattcaacggacgtctacgacctttatcgtcatacacttccagaatacgaataacatcctcagcaaacttctcacctgctaagtccataatgaagggacacttcacttcatttgggtcataagactgaacagcatacttagctagtaatgggtagttggttctaccttcttgcatctcaacaaccacgttgttgttacgcatgttgaagcgaccatgcagacgagtcagtgcctcattagcagctacgataatgaaaggcttactatcatcttcaatgtcacctttgtcatctgtaacgatacctgtattgttcagcacaccattagccagacgacagaataactcttctatatagtacataagtcctcacacgatatatgaagagagtgggttaacacttccagtatcatcaccatcatcccacaatgggtcacctgatgtattaactggaaccatacctgcttgcggtttccacgggttcaggtagccaagcattgaaatggtatcaatacagtcatccttacctttaagaccattgatagtggctaaacgaatttgccccataaagagtgtcatgattgggctatctttcatttcagcaggaaaatacatcttaccagctttgaaccagggaaccacgaggttaaaccttgatagcttactggttacaggatgaatacccggttggcctccacgactggatgcaaagttaaagaacacattacggttaagcatttccttctgaagaagagaaataaaaccaccttgctgtccagtagtttctacaccaacttgttgtggttggtattcctgaaccagacggaataagtcatcaaagttcttatccatagtttgacggcaagcaatgccatctacccagaaccagtcaccgttagaaccatatgcccatactgatattacagagtagtcagatacctgcttctcgctggtagcaaagtcagtggtgatatagaagttataacaagaacggagacgtaatagctgcgtacgggaataccatttaatctctgaatcctgaatcagacgttcatcttcagaactgatacgtaacatcaattcctgataaaaggatgccagcttacctgtcttcaatgccatctggtattggtcattgatgtagtcataggagaaacggtcttcccaagcaccttgaaattcttctcgcgtacatgggaatttctcacatacaggccatacgttgacatcccaagcaccagattcaactgcttcaataagaatatcttccttattaaagggagtaccattaaagattaccttacgtcttgttgggtcaagagcatggttcacacccttatataccgtgtctttaatggcttccattgatgtacgtgagcgagcatcatcatcactaactaagtcatccagtacgcaaagaacgggacgtttaccaaaaatcttagtaccacgaagacctgtcttagcaccaaacatcttcacaccaagacggtgaccttcagcatttacaaactcaaggtagttatctgtgaaggtagctttaggaacccattgttgcaggaatggtgaattgttgtatcgaaactcaatgttcttacgggcagacttaacaccgttatccatagagtcagatacataaatcattccttctactttacccaagctaggtagatgcccaaacactgctaagaacaaagtaaagtattccatgaacagagttgtctttgctgcaccacggaaacataagttagcaatgtactgattcttactggttatcttatccagcatctttaagtgaacaggaggggttttgtttgattccccctccttaccattaaccagcttaataaagttagcaaaggtcagtgcaaactcggttggtatatacgtaggggtattcagaacggaatagtccacttggtctagccattcatccaactcctgtttaattagttcagacatcaataatatcctcgtcttctcgaaccagtgtggaacctgcaattactttagtaggtgtaccagcttcaatagctgctttctgagcttcagccaactgggttagtgtgttcttgagttcagtcaatccagagttttctctcaaatccagattgatattagtaacagcatccttcggtttctggaggtgagtaaggatagagttggcagcatcacactgtaccttctcactggtagcattcttcatgagccatgcctgatggttcaatgcttcctgaaacaaatcctgattaacaatccatactggaatcagtgattgttccataatgaggtttactaacttacctctatggtaagcagatacataagcagagatgtccttctcactggttccccttgctactaattcagcttgtctgttggggaatgttttgaagtaagcatctttgttgctataccccatatgtttgtaagtaacatattgaacagcattaaggtaatcctgggtcttaaacttcccatccttcatcaccccagcataagtcacaaagttatttctaatttgctctgctgctgtctggtcttgggtcacattgttaatcatgtctaccagttggtcagtaacactgctcttaaactggggaggcaatgcagaaacaatgtctttcttagtcagtagtgtgctcatagtcttcctacaaattatctagagtgaagaggattcttttcttggggtcagtaccccttgcagaaacctatacatagatttagactttagactttctttagtctccttacaatagtaagacagagacatggggagcctattgcccaaaggaaccagtaacatgagactattctatagttttgacggtaatgaccaatggaatgagatagacttcagtaagataggtggagctatcccagttggaggggctacgccaggtgaccatatcttatgtcacgatgaggagtctttccattacatctcaggtatgatgttaatcaataacgtcactgggtttactgtccataaacctgcaccagtgcgtgtcattaccaagcctatcgagggtcttgcattctttacaagaatacctcaaagtatctctatcaaacgacagcgtgacgccatcgagatgaccgtggttgcttgataagccattgcccgcccaggagttggtggcgggaaacagggaactgtttgaataaccacttcagctacattcacccatctccaagacgcctttgttatctgccattgggtgatgagtagtatcagagagaactgatttaacaaacacactcggtataggaattgggagccatttggctccctttttcttttatgaaccaaggagttctatatgaacattcgtcctaatgaagtctatggtatcaacctagaatacactacaaacaaacctgctctgtttcactgtggctccaccaatctattccatgctatgtgtggtaataccaaacctctttacttacccgaatcagatgatacccatgccctgctaggtaactggttcttagaaggtaaagacattagtaccattcttcttgaaccaaggaagaaagtggcaatacctactaatgcatggaataacgaagtcatttacttcctagcaccaaaaggctttgaaccagtgatagaacagaatcactttaatcatgcagttactttctactttagagaggcttcaaagttatctgcttataaataaggaaagctatgtggtatataacagttaaaggtttatccgaaccagtgatgatagatagcctggcctttgtagaagtaggtcatcctattcttatagacggtaagttgtacgaagttgttagtatttataagagataaataggaagtctattagatagataccctataattttttcttagtgaaaatagtcatagttacttgtgagttcagtatt

SEQ ID NO: 12 - DNA, 39052 bp, artificial sequence
  BP1176
ctatcagtggaacctaaagagggtcttagagagggcctaaggagtttctagagggtcctttaaaatataccataaaaatctgagtgactatctcacagtgtacggacctaaagttccccccataggggtacctaaagcccagccaatcaccttgagtcaaccttcggttgaccttgagggtccctaagggttgggatttgtcctagagtgttacctttgggtgttaccttgagtgtgtctctgtgtcccctatctgttacagtctcctaaagtatcctcctaaagtcacctcctaacgtccatcctaaagcctacacctaaagactacacctaaagacaccatcgagtcaatgcctatcttaaagtatagacctaaagaccagacctaaagacactacataaagaccagacctaaagacgccttgttgttagccataaagggataatcttcaatcattgtctttaatcattgtctttaatcattgtctttaatacgactcactatagagagactacttaaagagccttaaagatagattaatttaaagatttattaaaagagtattgactttaagtctaacctataggatactttgattcatcgagagggacacggcgaataaccatcccaatcgataccggggtcaaccggataagtagacagcctgataagtcgtatgaaaaacaggtattgacaacatgaagtaacatgaagtaagatacacagcgtcagccactgatacggtgtcttctaggtgacttaagcgcaccacggcacataaagtgaaacaaaacggttgacaacatgaagtaaacacggtacgatgtaccacgaaatgacggaacagtgagtcaccacactgaaaggtgatgcggtctaacgaaacctgaccaaagacgctctttaacaatctggtaaatagctcttgagtgcatgactagcggataactcaagggtatcgcaaggtgccctttatgatattcactaataactgcacgaggtaacacaagatggctatgtctaacatgacttacaacaacgttttcgaccacgcttatagcttgctgaaagaaaacatccgttatgatgacatccgcgacactgatgacctgcacgatgctgttcatatggctgccgataatgcagtaccgcactactacgctgacatctttagcgtaatggcaagtgaaggtatcgaccttgagttcgaggactctggtctaatgcctgacaccaaggacgtaatccgcatcctgcaagctcgcatttatgagcaactcacgattgacctctgggaagacgctgaggacttactgaacgagtaccttgaggaagtcgaggaagaagaagactacgaagaggatgaagagtaatgtctaatagcacgcaatatggtctgaccgctcaaactgtactgttctatagcgatatggtgcgctgcggcttcaactggtcgctcgcaatggaacaccttaaggaactgtacgaaaacaacaaggcaatagccttggagtctgctgagtgataggctcaaggtcgctcctagcgagtggcctttatgattatcactttacttaaatgggagtaatgtatatgcttactatcggtctactcaccgctctaggtctagctgtaggcgcatcctttgggaagtctttgggtgtcgctgtaggcgcttacttggtcgcttgtatcatcacgggagcactacgcaaatgctgaaacactacgttatgtccatccacacatccaacggggcaacagtatgcacacctgatgggttcgcaatgaaacagcgaatagaacgccttaagcgtgaactccgcattaaccgcaagattaacaaaatctaatcacatttaatcacttggagaatacataaagtgaacatcaccgacatcatgaacgctatcgacgcaatcaaagcactgccaatctgtgaacttgacaagcgtcaaggtatgcttatcgacctgctggttgaaatggtcaacagcgaaacgtgtgatggcgaaataaccgaactaaatcaggcacttgagcatcaagattggtggactaccttgaagtgcctcacggctgacgcaggtttcaagatgctcggtaatggtcacttctcggctgcttatagtcaccctctgctacctaacagagtgattaaggtgggctttaagaaagaggactcaggcgctgcgtatactgcattctgccgcatgtaccaaggccgtgctggtatccctaacgtctacgacgttcagcgtcatgcaggatgctatacggtggtattggatgcactgaatgattgcgagcgtttcgacaacgatgagcattataaatacgctgagattgcaagcgacatcattgactacaaatccaatgagcacgatatgttaactgggtgggatggcgagttcgtcgagacttgtaagctaatccgcaagttctttgagggcatcgcttcgttcgacatgcacagcgggaacatcatgttcagcgacgatgatacgccgttcattaccgaccctgtatcgttctcgcagaagaaagacggtggcgcattcagcattgaccctgaggaactcatcaaggaagtcgaggaggtcgcacaccagagagcaatcgaccgcgctaaggaacgtaaagcacgtcatgtgggtcgagtggaggcacgtaaagtaaagcgccgtaaccgtaaggcacgtaaagtcaacctagctaagcacgaaagaagggttgctcggcggcgttgggttgaacgtcaagaacaacgagaccatcaaatcgctagggatgtgttaggtaacactgctcatctccttcgctggatgcaaatgcccgctgccgactttagggcgcttgaggaacgaatcgcagcgcactggcgtaatgttgaccggatggctatagctaacggtcttcctcttaacatcgacaagcaacttgacgcaatgctaatgggctgatagtcttatcttacaggtcatctgcgggtggcctgaatagatacgatttactaaccggaagaggcacgaaatgaacacgattaacatcgctaagaacgacttctctgacatcgaactggctgctatcccgttcaacactctggctgaccattatggtgagcgtttagctcgcgaacagttggcccttgagcatgagtcttatgagatgggtgaagcacgattccgcaagatgtttgagcgtcaacttaaagctggcgaggttgcggataacgctgccgctaagcctctcattactactctgctccccaagatgattgcacgcatcaacgattggtttgaggaagtgaaagctaagcgcggcaaacgcccgacagccttccagttcctgcaagaaatcaagccggaagctgtagcgtacatcaccattaagaccactctggcttgtctaaccagcgcagacaatacaaccgttcaggctgtagcaagcgcaatcggtcgagccattgaggatgaggcgcgcttcggtcgtatccgtgaccttgaagctaagcacttcaagaaaaacgttgaggaacaactcaacaagcgcgtagggcacgtctacaagaaagcgtttatgcaggttgtcgaagctgacatgctctctaagggtctactaggtggcgaggcgtggtcttcgtggcataaggaagactccatccacgttggggtgcgctgcattgagatgctaattgagtcaaccggaatggttagcttacaccgccaaaatgctggcgtagtcgggcaagactctgagactatcgaactcgcaccagaatacgctgaggctatcgcaacccgtgcaggtgctctggctggtatctctccgatgttccaaccttgcgtagttcctcctaagccgtggactggtattactggtggcggctattgggctaacggtcgccgtcctctggcactggtacgtactcacagtaagaaagcactgatgcgctatgaagacgtttacatgcctgaggtatacaaggcgattaacattgcgcaaaacaccgcatggaaaatcaacaagaaagtcctagcggtcgccaacgtaatcaccaagtggaagcactgcccagtagaggacatccccgcgattgagcgtgaagaactaccgatgaaaccggaagacatcgacacgaatcctgaggctctcaccgcatggaaacgtgccgctgccgctgtgtaccgtaaagacaaggctcgcaagtctcgtcgtatcagccttgagttcatgcttgagcaagccaacaagtttgctaaccataaggccatctggttcccttacaacatggactggcgcggacgtgtttacgctgtgtcaatgttcaacccgcaaggtaacgatatgaccaaaggactgctgacgctggctaaaggtaagccaatcggtaaggaaggttactactggttgaagattcacggtgcaaactgcgctggtgtcgataaggttccgttccctgagcgcatcaagttcattgaggacaaccacgagaacatcatggcttgcgctaagtctccactggagaacacttggtgggctgagcaagattctccattctgcttcctcgcgttctgctttgagtacgctggggtacagcaccacggcttaagctacaactgctcgttacctctggcgtttgatgggtcttgctctggcattcagcacttctcagctatgctccgcgatgaggtaggtggtcgtgctgttaacctgctacctagtgaaaccgttcaggacatctatgggattgttgctaagaaagtcaacgagattctacaagcagacgtaatcaacgggaccgacaacgaagtagttaccgtgaccgatgagaacactggggaaatctctgagaaagttaagctgggcactaaggcgctggctggtcaatggctggcttacggtgttactcgcagcgtgactaagcgttcagtcatgacgctggcttacgggtccaaagagttcggcttccgtcaacaagtgctggaagataccattcagccagctatcgattccggtaagggtctgatgtttactcaaccgaatcaggctgctggatacatggcgaaactgatttgggaatctgtaagcgttacggtggtagccgctgtggaggcaatgaactggcttaagtctgctgctaagctgctggctgctgaggtcaaagataagaagactggagagattctacgcaagcgttgcgctgtacactgggtgactcctgatggtttccctgtgtggcaggaatacaagaagcctattcagactcgcttgaacctgatattcctaggtcagttccgtctacagccgaccattaacacaaacaaggatagcgagattgacgcgcacaagcaggagtccggtatagctcccaactttgtgcatagtcaagatggtagccacctgcgtaagactgtagtgtgggcgaatgagaagtacggaatcgaatcttttgcgctgattcacgactccttcgggacaattccggctgatgctgccaacctgttcaaagcggtgcgtgaaactatggttgacacctatgagtcttgtgatgtactggctgacttctatgaccagttcgctgaccagttacacgagtctcaattggacaaaatgccagcacttccggctaaaggtaacttgaatctccaagacatccttaagtcagacttcgcgttcgcgtaacgtaaaattaatacgactcactatagagggacaaactcaaggtcattcgcaagagtggcctttatgattgaccttcttccggttaatacgactcactataggagaaccttaaggtttaactttaagacccttaagtgttaattagagatttaaattaaagaattactaagagaggactttaagtatgcgtaacttcgaaaagatgaccaaacgttctaaccataacgctcatgacttcgaggcaactaagggtcgcaagttgaataaaccattacgaacccgtgcacataaacgctgctgggagggtcaataagatgggacgtttatatagtgggaacttgaatgacttcaaggctgcttgcaacaggctctaccagttggacattgcggtcatatgtgatgatttatatgaagacaatgggcatagacagggcgttaaagtcagtatcgaagacaggactggaaacctgattgactccagaacattctttcatcgcgatgaagacgtcttgtacaacataagcaccgcttggctgaaccatgtgtacgaccagttgaaggactggaagtaatacgactcagtatagggacaatgcttaaggtcgctcgctgagtggccttagtcatttaaccaaaacatggagataaacattatgatgaacattaagactaacccatttaaagccgtgtctttcgtagagtctgccattaagaaagctctggataacgctgggtatcttatcgctgacatcaagtacgatggtgtacgtgggaacatctgcgtagacaataccgctaactgctgctggctctctcgtgtatctaaaacgattccggcgctggagcacttaaacgggtttgatgttcgctggaagcgtctgctgagcgatgaccgttgcttctacaaagatggctttatgcttgatggggaactcatggtcaagggcgtagactttaacacagggtccggcctactgcgtaccaaatggactgacacgaagaaccaagagttccacgaagagttattcgttgaaccagtccgtaagaaagataaagttccatttaagctgcacactggacaccttcacgtcaaactgtacgctatcctcccgctgcacatcgtggagtctggagaagactgtgatgtcatgacgttgctcatgcaggaacacgttaagaacatgctgcctctgctacaggaatacttccccgaaatcgaatggcaagctgctgagtcttacgaggtttacgacatggtagaactacagcaactgtacgagaagaagcgtgaagaggggcatgagggtctcattgtgaaagacccgatgtgcatctacaagcgcggtaagaagtccggctggtggaaacttaagccagagaacgaagctgacggtatcattcagggtcttgtgtggggaaccgaaggtttagcaaatgaaggtaaagtaatcggatttgaggtgcttcttgagagtggtcgtgtagttaacgccacaaacatctctcgcaccttaatggacgaatttactaacacagttaacattgaaggtgaaacctactacaacggacacgcttgccagattagctacatggaggaaactcctgacggctctctgcgtcacccatcgttcgtaatgttccgtggcaccgaggataaccctcaagagaaaatgtaatcacactggctcaccttagggtgggcctttctgcgtttataaaggagacactatatgtttaagaaggttggtaaattccttgcggcttgggccgttatcctcatattcacatatcttctggttgttcatcctccggtagcgtttgtgtttatcggcgggtgcttactcatctcagcatgtatatgcgtgtggagtatagttaactgttaatacgactcactaaaggagatacactatgatgtacttaatgccattactcattgtcatcgtaggatgccttgcgctccactataacgacgacgatatgccagatggtcacgcttaatacgactcactaaaggagacactatatgtttcgactacattacaacaaaagtcttgagaatttcacggttcgccgtgctgaccgttcaatcgtatgtgcgagcgagcgccgagctaagctacctcttattggtaacacagttcctctggcaccgagcgtccacatcattatcacccgtggtgactttgagaaagcaatagacaagaaacgtccggttctcagtgtggcagtgacccgcttcccgttcgtccgtctgttaatcgaaagaatcaaggagatgttctgatgggatgtatagcttgcttagagagagacgaccgttatccacacacctgtaataaaggagctaataatatgacagaacgtgagcaacagattatcattcagttgatagacaataacgaaggtcgtagcggagacacatctggctgtggcctgttctgcgctggagtaccttgtggcgagtgtcctgtaacaaacgattcgcgcattaccctaggtgaaatacgagcgatggacccgcgcaaatatcatcgtaataaacttgaggtaactcctacagatgaccagccttccgctgaatcaatcgaaggtgtcactaagccttcccattacatgctgttcgacgacattgaggctatcgaagtgattgcccgttcaatgactcgtgagcagttcaaagggtactgcttagggaacatccttaagtaccgcctacgtgctggtaagaagtccgaactggcttacttagagaaagacatggcgaaagctggcttctacggtgaactgtacgagaaacataaggataagtgctatgacgcgtgaagaacttcaatctgcatcggtgaagcgtagagcgcacaggttctatcgggcatacaaggcgctgcgcatgggtatgttgatgttctcgttaggacacagtgagtattgtgacagcgacctcctaccgtttgcttataagaagacacctagtctgattattaaggtagaggagtatgaatattctgacgactgtgttatggtgaaccgctatgcttaagccttccgactggtgtcacaagatgtggactgaatgtatagaacgtggtgatgaggaatccgctagtcactacatggaactttacaaccaatggctatcgagaggttactgatatgtcaaacataaatacaggttcactcattgtgaacaataagaagttttgggctaccgtagagtcctctgagcattcctttgaggttccaatctacgcggagaccctagacgaagctgtggagttagctgaatggcaatatggtcattgtggctttgaggttactcgtgtgcgcccttgtgtagcaccgaagtaatacgactcactattaggaagactccctttgagaaaccaaacgaaacctaaaggagattaacattatggctaagaagattttcacctctgcactgggtactgctgaaccttacgcttacatcgctaagccggactacggcaacgaagagcgtggctttgggaaccctcgtggtgtctacaaagttgacctgactattcccaacaaagacccgcgctgtcaacgcatggtcgatgaaatcgtgaagtgtcacgaagaggcttatgctgctgccgttgaggaatacgaagctaatccacctgcggtagctcgtggtaagaaaccactgaaaccgtatgaaggggacatgccgttcttcgataatggtgaaggcacgactacctttaagttcaaatgctacgcgtctttccaagacaagaagaccaaagagaccaagcacatcaatctggtcgtggttgactccaaaggtaagaagatggaagacgttccgattatcggtggcggctctaagctgaaagtcaagtactctctggttccgtacaagtggaacaccgctgtaggtgcgagcgttaagctgcaactggaatccgtgatgctggtcgaactggctacctttggtggcggtgaagacgattgggctgacgaagttgaagagaacggctatgttgcctctggttctgccaaagcgagcaaaccacgcgacgaagaaagctgggacgaagacgatgaagggtccgaagaagcagacgaagacggagacttctaagtggctggcgcatacgctgcgcgtggtatccgaaaggtcgggacattccgttccggcctagaagataaggtctctaagcagctagagggtaagggaattaagttcgactatgaactgtggaaaatcccttacgttgtccctgcgagcaaccatgtgtatactccagacttcctgctgcctaacggaatctttattgaaaccaaaggtttatgggagagtgacgaccgaaagaaacacttattgattcgcgaacagtttcctgaactggacatccgtctggtgttctcaagctcgcgcaccaagctgtacaaagggtctccgaccagttacggcgaatggtgtgagaagcacggtattctgtttgctgacaaattaattcctgtagaatggctcaaagaacccaaaaaggaggtgccatttgacaagctgaaacaatcgaagggaggaaagaaataatggctcgtgtacagtttaaacaacgtgaatctactgacgcaatctttgttcactgctcggctaccaagccaagtcagaatgtaggtgtccgtgagattcgccagtggcataaagagcaaggttggcttgatgttgggtatcactttattatcaagcgagatggcactgtggaggaaggccgagatgagatggctgtaggctctcacgctaagggatacaaccacaactctataggtgtctgccttgtaggtggtatcaacgataaaggcaagttcgacgctaactttacgccagcccaaatgcaatcccttcgctcactgcttgtcacactgctggctaagtatgaaggctctgtgctgaaggctcatcacgatgtggcaccgaaggcttgcccttcgttcgaccttaagcgttggtgggagaagaatgaacttgtaacttctgaccgagggtaaacatgattattcatgaaatgggtttatacgatttgatttatcatcttgctttcttactggcaatggtgtacgtactgacccgtaactaatttaattgaactcactaaagggagaccacaacggtttccctttgttcgcaatgttgattaaggaataaccatatggaattagagcaagatagtattttcctgtatcatgctccttgcgagaactgtgggtcttctgatggtaactctgtgtattctgacggccatcaattttgctttgtatgtgagcacagggttccagcctcagaagaacgtaaacaggagctatcatcaagaagacgtatagtcggtggaggtaaaccaatgacttacaacgtatggaacttcggggagtccaatggacgttactccgcgttaactgcgcgaggaatctcaaaggaaacctgccagaaggctgggtactggattgccaaagtagacggtgtgatgtaccaagtggctgactatcgtgaccagaacggtaacattgttagccagaaggttcgagataaagataagaactttaagaccactggtagtcacaagagtgatgctctgttcggtaagcacctgtggaatggcggtaagaagattgttgtcacagaaggtgaaatcgacatgcttaccgtgatggaacttcaagactgtaagtatcccgtagtgtcgttgggtcacggtgcctctgccgctaagaagacatgcgctgccaactacgaatactttgaccagttcgagcagattatcttgatgttcgatatggacgaagctgggcgcaaggcagtagaagaggccgcacaggttctacctgctggtaaggtacgagtggcagttcttccgtgtaaggatgccaacgaatgtcacctcaatggtcatgaccgtgaaatcatggagcaagtctggaacgctggaccttggattccagatggtgtggtatcggctctttcgttacgtgagcgaatccgtgagcacctatcgtcagaggaatcagtaggtctacttttcagcggctgcacaggtatcaacgataagaccttaggtgcccgtggtggtgaagtcattatggtcacttccggttccggtatgggtaagtcaacgttcgtccgtcaacaagctctccaatggggcacagcgatgggcaagaaggtaggcttagcgatgcttgaggagtccgttgaggagaccgctgaggaccttataggtctacacaaccgtgtccgactgagacaatccgactcactaaagagagagattatcgagaacggtaagttcgaccaatggttcgatgaactgttcggtaacgatacgttccacctatatgactcattcgctgaggctgagactgatagacttctcgctaagctggcctacatgcgctcaggcttgggctgtgacgtaatcattttagaccacatctcaatcgtcgtgtccgcttctggtgaatccgatgagcgtaagatgattgacaacctgatgaccaagctcaaagggttcgctaagtcaactggtgtggtgctggtcgtaatttgtcaccttaagaacccagacaaaggtaaagcacatgaggaaggtcgccccgtttctattactgacctacgtggttctggcgcactacgccaactatctgatactattattgcccttgagcgtaatcagcaaggcgatatgcctaaccttgtcctcgttcgtattctcaagtgccgctttactggtgatactggtatcgctggttacatggaatacaacaaggaaaccggatggcttgaaccttcaagttactcaggggaagaagagtcacactcagagtcaacagactggtccaaagacactgacttctgacaggattcttgacgatttcaatacgactcactaaaggagacacacaatgttcaaactgattaagaaattaggccaactgctggttcgtatgtacaacgtggaagccaagcgtcttaacgatgaggctcgtaaagaggccacacagtcacgcgctctggcgattcgcgccaacgaactagctgacagtgcgtccaataaggttacagaagctgcccgtgtagcaaaccaagctcagcaactttccaaattctttgagtaatcaaacaggagaaaccattatgtcaaacgtagctgaaactatccgtctatccgataccgctgaccagtggaaccgtcgagttcacatcaacgttcgcaacggtaaggcgactatggtttaccgctggaaggactctaagtcctctaagaatcacactcagcgtatgacgttgacagatgagcaagcactgcgtctggtcaatgcgcttaccaaagctgccgtgacagcaatccatgaagctggtcgcgtagatgaagccatggctatcctcgacaagattgatagctaagagtggtatactcaaggtcgcccaagtggtggccttcatgaatactattcgactcactataggagatattaccatgcgtgaccctaaagttatccaagcagaaatcgctaaactggaagctgaactggaggatgttaagtaccatgaagctaagactcgctccgctgttcacatcttgaagaacttaggctggacttggacaagacagactggctggaagaaaccagaagttaccaagctgagccacaaggtgttcgataaggacactatgacccacatcaaggctggtgattgggttaaggttgacatgggagttgttggcggctacggctacgttcgctcagtgagtggtaaatatgcacaagtgtcatacatcacaggtgttactccacgcggtgcaatcgttgccgataagaccaacatgattcacacaggtttcttgacagttgtttcatacgaagagattgttaagtcacgataatcaataggagaaatcaatatgatcgtttctgacatcgaagctaacgccctcttagagagcgtcactaagttccactgcggggttatctacgactactccaccgctgagtacgtaagctaccgtccgagtgacttcggtgcgtatctggatgcgctggaagccgaggttgcacgaggcggtcttattgtgttccacaacggtcacaagtatgacgttcctgcattgaccaaactggcaaagttgcaattgaaccgagagttccaccttcctcgtgagaactgtattgacacccttgtgttgtcacgcttgattcattccaacctcaaggacaccgatatgggtcttctgcgttccggtaagttgccggggaaacgctttgggtctcacgctttggaggcgtggggctatcgcttaggcgaaatgaaaggtgaatacaaagacgactttaagcgtatgcttgaagagcagggtgaagaatacgttgacggaatggagtggtggaacttcaacgaagagatgatggactataacgttcaggacgttgtggtcactaaagctctccttgagaagctactctctgacaaacattacttccctcctgagattgactttacggacgtaggatacactacgttctggtcagaatcccttgaggccgttgacgttgaacatcgcgctgcatggctactcgctaagcaagagcgcaatgggttcccgtttgacacgaaagcaatcgaagagttgtatgtagagttagctgctcgacgctctgagttgctgcgtaaattgaccgaaacgttcggctcgtggtatcagcctaaaggtggcaccgaaatgttctgccatccgcgaacaggtaagccactgcctaaatatcctcgcattaagacacctaaagttggtggtatctttaagaagcctaagaacaaggcacagcgagaaggccgtgagccttgcgaactggacacccgcgagtacgttgctggtgctccttatacgccagttgagcacgtagtgtttaacccatcgtctcgtgaccacattcagaagaaactacaagaggctgggtgggttcccacgaagtacaccgataagggtgctcctgtggtggacgatgaggtactcgaaggagtacgtgtagatgaccctgagaagcaagctgcaatcgacctcattaaagagtacttgatgattcagaagcgaatcggacagtctgctgagggagacaaggcatggcttcgttacgttgctgaggacggtaagattcatggttctgttaaccctaatggagcagttacgggtcgtgcgacccatgcgttccccaaccttgcgcaaattccgggtgtacgttctccttatggagagcagtgtcgcgctgcttttggcgctgagcaccatttggatgggataactggtaagccttgggttcaggctggcatcgacgcatccggtctggagctacgctgcttggctcacttcatggctcgctttgataacggcgagtacgctcacgagattcttaatggcgacatccacactaagaaccagatggctgctgaattgcctacccgtgataatgctaagacgttcatctatgggttcctttatggtgctggtgatgagaagattgggcagattgttggtgctggtaaagagcgtggtaaggaactcaagaagaaattccttgagaacacccccgcgattgcagcactacgtgagtctatccaacagacacttgtagagtcatctcagtgggtagcaggtgaacaacaagtcaagtggaaacgccgctggattaaaggtctggatggtcgtaaggtacacgttcgtagtcctcacgctgccctgaataccctactgcaatccgctggtgctctcatctgcaaactgtggattatcaagaccgaagagatgctcgtagagaaaggcttgaagcatggctgggatggggactttgcgtacatggcatgggtacatgatgaaatccaagtaggttgccgtaccgaagagattgctaaggttgtcattgagaccgcacaagaagcaatgcgctgggttggagaccactggaacttccggtgtcttctggataccgaaggtaagatgggtccgaattgggccgtatgtcactaattctataggagaaattattatggctatcactaagaaatttaaagtgtcctttgatgttacccttaagctggacagcgataccgaagaaatgatgcgagaaaaaattctggacctcgcccatcgtgctggggctggtgagaagattgcacctatggacagagagttgctagttcaggctctgacccgtggcccagacggcgctgctgccttcgctgtgcgccaatgtctccgtaatgctatcaaagagttgttcgaagagatgagcgatgcgtcactgttcaaagcgtctcctgcaactgtgcgggaggtgttctgatgtctgactatctgaaagtgctgcaagcaatcaaaagttgccctaagactttccagtccaactatgtacggaacaatgcgagcctcgtagcggaggccgcttcccgtggtcacatctcatgtctgaccacaagtggacgtaacggtggtgcttgggaaattacggcttctggcactcgctttctgaaacgaatgggaggatgtgtctaatgtctcgtgaccttgtgactattccgcgcgatgtgtggaacgatatgcagggctacatcgactctctggaacgtgagaacgatagccttaagaatcaactaatggaagctgacgaatacgtagcggaactagaggagaaacttaatggcacttcttgaccttaaacaattctacgagttacgtgaaggctgtaacgacaaaggtatccttgtgatggatggcgactggctggtcttccaagcgatgagtgctgctgagtttgatgcctcatgggaggaagagatttggcaccgctgctgtgaccacgctaaagcccgtcagattcttgaggattcaattaagtcctacgagacccgtaagaaggcttgggtaggtgctccgattgtccttgcgttcactgatagtgttaactggcgtaaagaactggttgacccgaactacaaggctaaccgtaaggcaaccaagaaacctgtgggttactttgagttccttgatgctctctttgagcgcgaagagttctattgcatccgtgagcctatgcttgagggtgatgacgttatgggagttattgcttccaatccgtctgcattcggtgctcgtaaggctgtaatcatctcgtgcgataaggactttaagaccatccctaactgtgacttcttgtggtgcaccactggtaacatcctgactcagaccgaagagtccgctgactggtggcacctcttccagacaatcaaaggtgacatcaccgatggttactcagggattgccggatggggtgataccgccgaggacttcttgaataacccgttcatagtcgagcctaaaacgtctgtgcttaagtctggcaagaacaaaggtcaagaggttactaaatgggttaagcgtgcccctgagcctcatgagactctttgggactgcattaagtccattggcgctaaggctggtatgaccgaagaggatattatcaagcagggccagatggctcgcatccttcggttcaacgagtacaactttattgacaaggagatttacctgtggagaccgtagcgtatattggcattggtctttgtgtcctaggaatgggcctcattgcgtggggactttgggacttagcccgaataatcaagtcgttacacgacactaagtgataaactcaaggtccctaaattaatacgactcactatagggagataggggcctttatgattattactttaagatttaactctaagaggaatctttatcatgttaacacctattaaccaattacttaagaaccctaacgatattccagatgtacctcgtgcaaccgctgagtatctacaggttcgattcaactatgcgtacctcgaagcgtcaggtcatataggacttatgcgtgctaatggctgtagtgaagctcacatcttgggcttcattcagggcctacagtatgcctctaacgtcattgacgagattgagttgcgcaaggaacaactaagagatgatggggaggattgaccttatgtgtttctcaccgaaagttaaagttccgaagatggataccaatcagattcgagccgttgagccagcgcctctgacccaagaagtgtcaagcgtggagttcggcgggtcttctgatgagacggataccgaaggcaccgaagtgtctggacgcaaaggcctcaaggtcgaacgcgatgattccgtagcgaagtctaaagccagcggtaatggctctgctcgtatgaaatcttccatccgtaagtccgcatttggaggtaagaagtgatgtctgagttcacatgtgtggaggccaagagtcgcttccgtgcaatccggtggactgtagaacaccttgggttgcctaaaggatttgaaggacactttgtgggctacagcctctacgtggatgaagtaatggacatgtctggttgtcgtgaagagtacattctggactctacaggaaaacatgtagcgtacttcgcgtggtgcgtaagctgtgacattcaccacaaaggagacattctggatgtaacgtccgttgtcattaatcctgaggcagactctaagggcttacagcgattcctagcgaaacgctttaagtaccttgcggaactccacgattgcgattgggtgtctcgttgtaagcatgaaggcgagacaatgcgtgtatactttaaggaggtataagttatgggtaagaaagttaagaaggccgtgaagaaagtcaccaagtccgttaagaaagtcgttaaggaagtggctcgtccggttaaacaggttgctggtgcgctggcaggtggcgctggtgaagcacaagtggtggaagttccacaagctgctgcaacacctgctgcacagattgttgacgtacctgagaaagaggtttccactgaggacgaagcacagaccgaaagcggacgcaagaaagctcgtgctggcggtaagaagtccttgagtgtagcccgtagctccggtggcggtatcaacatttaatcaggaggtgacacatggccgagaagcgtacaggtctagccgaggaaggtgcaaagtccgtttatgaccgattgaagaacgaccgcgctccttatgagactcgtgctcaaaactgcgctcagtacaccattccgtccctcttccctaaggattccgataactcatccacagactacacaactccgtggcaagctgtgggtgctcgcggtctcaataacttggcctctaagctcatgctggcgctcttcccgatgcaaacgtggatgaagctgaccatctctgagtatgaagccaaacagttactgaatgaccccgatggactcgctaaggtcgatgagggtctctcaatggtagagcgtatcatcatgaactacattgagtctaacagttaccgagttactctctttgaggctctcaagcagttagtcgtagcgggtaacgtcctgctgtacctaccggaaccggaagggtcaaactacaatcccatgaagctgtaccgattgtcttcttatgtggtccaacgagacgcattcggcaacgttctgcaaatggtgactcgtgaccagatagcttttggtgctctccctgaggacatccgtaaggctgtagaaggccaaggtggtgagaagaaagctgacgagacagtagatgtatatactcacatctatctggatgaggactcaggtgaatacctccgatatgaagaggtagagggtatggaagtacaaggctccgatgggtcttaccctaaagaggcttgcccatatatcccgattcgaatggttcgtctggatggtgaatcctacggtcgttcgtacattgaggaatatctcggtgacttacggtcccttgagaatctccaagaggccatcgtcaagatgtccatgattagctctaaggttatcggcttagtgaatcctgctggtatcacccagccacgccgactgaccaaagctcagactggtgacttcgttactggtcgtccagaagacatctcgttcctccaactggagaagcaagcagactttactgtagccaaggctgtcagtgacgctatcgaggctcgcctttcgtttgcctttatgttgaactctgcggttcagcgcacaggcgaacgtgtgaccgccgaagagattcggtatgtcgcttctgaacttgaagatactctaggtggtgtctactctatcctttctcaagaattacaattgcctctggtacgagtgctcttgaagcaactacaagccacgcaacagattcctgagttacctaaggaagccgtagaaccaaccattagtacaggtctggaagcaattggtcgaggacaagaccttgataagttggagcgttgtgtcaccgcgtgggctgccctagctcctatgcgtgatgaccctgacatcaaccttgcgatgattaagttgcgcattgcgaacgctatcggtattgacacttctggtattctccttaccgaagaacagaagcaacagaagatggcccaacagtctatgcaaatgggtatggataatggtgctgccgcgctggctcaaggtatggctgcacaggctacagcttcacctgaggctatggctgctgccgctgattccgtaggtctacagccgggcatttaatacgactcactatagggagagtaagacttcgaggcaatccgtactgcggaccttcgctgcgtctccctgtagttcaactttaaggagacaataataatggctgaatctaatgcagacgtatatgcatcttttggcgtgaactccgctgtgatgtctggtggttccgttgaggaacatgagcagaacatgctggctcttgatgttgctgcccgtgatggcgatgatgcaatcgagttagcgtccgacgaagtggaaacagaacgtgacctgtacgacaactctgacccgttcggtcaagagggtgatgaggggcgcattcaggttcgcattggggatggctctgagacgacagatgttgacactggagaagaaggctttgagggcaccgaaggttccgaagagtttaccccgctgggtgagactccagaagaactggtagctgcctctgagcaacttggtgagcacgaagagggcttccaagagatgattaacattgctgccgagcgtggcatgagcgttgagacaatcgaggccatacagcgtgagtacgaggagaacgaagagttgtccgctgagtcctacgagaagctggctgagattggttacacgaaggcgttcattgactcgtacattcgtggtcaagaggcgctagtggagcagtacgtaaacagtgtcattgagtacgctggcggtcgtgagcgttttgacgcactgtacaatcaccttgagacgcacaaccctgaggctgcacagtcactggacaatgcgttgaccaatcgtgacttagcaacagttaaagccatcattaacttggctggcgagtctcgtgctaaggcgttcggtcgtaagccaactcgtagtgtgactaatcgtgctattccggctaaacctcaggctaccaagcgtgaaggctttgcggaccgtagcgagatgattaaagctatgagtgaccctcggtatcgtacggatgccaactatcgccgtcaagtcgaacagaaagtaatcgactcgaacttctgatagactctgaaattaatacgactcactatagggagaccacaacggtttccctctaggaataactttgtttaactttaagaaggagacatacatatggctaacatgactggtggacagcaactgggtactaaccaaggtaaaggcgcaagtgctcctgataaactggcgttgttcttgaaggtatttggtggtgaagttctgactgcattcgctcgtacctctgtgaccacttctcgccacatggtccgttccatctccagtggtaaatctgctcagttccctgttctgggtcgcactcaggcagcgtatctggctccgggtgaaaacctcgatgataaacgtaaagacatcaaacacaccgagaaggtaatcaccattgatggcctcctgacggctgacgttctgatttacgacattgaggacgcgatgaaccactatgacgttcgctctgagtacacctcccagttgggtgagtctctggcgatggctgctgatggtgcggttctggctgagattgctggcctttgtaacttggcgagcgcctctaatgagaacattgagggcctaggcactgccactgtgattgagaccactcaggccaagagtgcgcttaccgaccaagttgctctgggtaaggagattattgcggctctgactaaagctcgtgcagctctgaccaagaactacgttccggctgctgaccgcgtgttctactgtgacccagatagctactctgcgattctggcggcgctgatgccgaacgctgcaaactacgctgctctgattgaccctgagaagggttctatccgcaacgttatgggctttgaggttgtcgaagttccacacctgacctctggtggtgctggtactgcgcgcgatggtgtaactggtcagaagcacgtattccctgccactaagagtggtaatgacaaggttgctaaggacaacgttatcggcctgttcatgcaccgctctgcggtaggtactgttaagctgcgtgacttggctctggagcgcgctcgccgtgctaacttccaagctgaccagattatcgctaagtacgcaatgggccatggtggtctgcgcccagaagctgctggcgcagtggttttcaagacggagtaatgctgggggtggcctcaacggtcgctgctagtcccgaagaggcgagtgttacttcaaccgaagaaaccttaacgccagcacagaaggccgcacgcacccgcgctgctaacaaagcccgaaaggaagctgagttggctgctgccgccgctgagcaataactagcataaccccttggggcctctaaacgggtcttgaggggttttttgcttaaaggaggaactatatgcgctcttacgatatgaacgttgagactgccgctgagttatccgctgttaacgacattctggcatctatcggtgaacctccggtatcaacgctggaaggtgactctaacgcagacgtggctaacgctcggcgtattctcaacaagattaaccgtcagattcagtctcgtggctggacgttcaacattgaggaaggcataacgctattacctgatgtttactccaacctgattgtatacagtgacgactatttatccctaatggctacttccggtcaatccatctacgttaaccgaggtggctatgtgtatgaccgaacgagtcaaacagaccgctttgactcgggtattaccgtgaacattatccgtcttcgagactacgatgagatgcctgagtgcttccgttactggattgtcaccaaggcttcccgtcagttcaacaaccgattctttggggcaccagaagtagaaggtgtacttcaagaagaggaagatgaggctcgacgtctctgtatggagtacgaagtggactacggtgggtacaatatgctggatggcgatgcgttcacttctggtctactgactcgctaatagtaaataaggaggctctaatggcactcattagccaatcaatcaagaacttgaagggtggtatcagccaacagcctgacatccttcgttatccagaccaagggtcacgccaagttaacggttggtcttcggagaccgagggcctccaaaagcgtccacctctggttttccttaagaccctaggaggaagcggtgacttaggacaagcaccttacatccatctgattaaccgtgatgagaacgaacagtattacgctgtgttcactggtacaggaatccgtgtgtttgaccttgctggtaacgaaaagcaggtacgataccctacagatggttctacgtacatccagacgaataaccctaggaatgacctaaggatggtcacggtggctgactatacgttcatcgtcaacagaaatatccgtgtcacgcgaaataccaactcagtgaacctagcaggatttaaccctaagcaggacgctctgataaacgttcgcggtggtcagtatggtcgtaccttacagattatgattaacggtggtttacaagcctcctatcagattcctgacggttcacagccagcacacgttaataacacggacgctcagtggttagcagaagagttggctcgccagtgtagagcaaatgctcctggatgggccttcaatgttgggcagggttttattcacatcatagcacctgctggtcaacagattgattccctgatgactaaggatggatatgctgaccaattgattaaccctgttacccactacgctcagtcattctctaagttacctcctaacgctcctgatgggtacatggtgaaaatcgtaggggattcctctaagtctgctgaccagtattacgttaggtatgacgctacgcgtaaagtgtggtcggagacattggggtggaacgttaacaaccagcttctgtttgagactatgccgcacgcgcttgttcgagctgctgatggtaactttgagttcaggtggcttgagtggagtcctaaaacctgtggtgatgacgacacaaacccgtggccttccttcatggattccacaatcaacgatgtgttcttcttccgtaaccgtttgggtttccttagtggagagaatatcatcctgagtagaaccgctaagtacttcaacttctacccagcgtcaatcgcaaacttgagcgacgatgaccctatcgacgtagctgtgagtaccaaccgaatcgcaatccttaagtatgccgttccgttctcagaagagttactcatctggtccgacgaagcacaatttgtcctgactgcttccggtactctcacgtcgaagtcagttgagttgaacctaacgactcagtttgacgtacaggaccgagcgagaccttatgggattgggcgtaatgtctactttgctagtccgaggtccagcttcacgtccatccacaggtactacgctgtgcaggatgtaagttccgttaagaacgctgaggacattacagcacacgtccctaactacatccctaatggtgtgttcagtatttgtggtagtggcactgaaaacttctgttcggtactatctcacggggacccaagtaaaatcttcatgtacaaattcctgtacctgaacgaagagttacggcaacagtcatggtcgcattgggactttggggaaaacgtacaggttctagcgtgtcagagtatcaactcagatatgtatgtgattcttcgtaatgagttcaatacgttcctagctaaaatatctttcactaagaacgccattgacttacaaggtgaaccctatcgggcctttatggatatgaagattcgctacacgattccaagcggaacgtataacgatgacacttatgaaacttcaatacacttaccaaccgtctacagcgccaacttcggtaggggcaaaatcactgtattggagcctgatggtaagataaccgtatttgagcaacctacagctgggtggcatagtgacccttggctgagactcagcggtaacttggagggacgcatggtgtacattgggttcaacattaacttcgtctatgagttctctaaattcctcatcaagcaaactgccgacgatgggtctacctcaacggaagacattggtcgcttacagttacgccgagcgtgggttaactatgagaactctggtacgtttgacatttatgttgagaaccaatcgtccaactggaagtacacaatggctggtgcgcgcttaggctctaacactttgagggctgggcgattgaacttagggaccggacaatatcgattccctgtggttggtaacgctaagttcaatactgttaccatcttgtccgatgagactacaccactgaacatcattgggtgtggctgggaaggtaactacttacggagaagttccggtatttaattaaatgttctccctgtggtggctcgaaattaatacgactcactatagggagaacaatacgactacgggagggttttcttatgatgattataagacctactaaaagtacagactttgaggtattcactccggctcaccatgacattcttgaagctaaggctgctggtattgagccgagtttccctgatgcttccgagtgtgtcacgttgagcctctatgggttccctctagccataggtggcaactgtggggaccaatgctggttcgttacgagcgaccaagtgtggcgacttagtggaaaagctaagcgagagttccgtaagttaatcatggagtatcgcgataagatgcttgagaagtatgatactctttggaattacgtatgggtaggcaatacgtcccacattcgtttcctcaagactatcggtgcggtattccatgaagagtacacacgagatggtcaatttcagttatttacaatcacgaaaggaggataaccatatgtgttggatggctgcaattccaatcgcattggctggtgctcaggctattagcggtcagaacactcaggccaaaatgattgccgctcagaccgctgctggtcgtcgtcaagctattgaactcatgaagcagacgaacatccagaatgctgacctatcgctgcaagctcgaagtaaacttgaggaagcatcctccgagttgaccgctcagaacatgcagaaggtacaagctctggggtctatccgagcggctatcggggagagtatgcttgaaggttcctcaatggaccgcattaagcgagtcacagagggacagttcattcgggaagccaatatggtaactgagaactatcgtcgtgactatcaagcaatcttcgcacagaaacttggcggtactcaaagtgctgcaagccagattagcgaaatctataagggcgaacagaagcagaagagtaagctacagatggttctggacccactggctatcatggggtcttccgctgcgagttcgtatgcatccggtgcgttcgactctaagtcaaccactaaggcacctattgttgccgctaaaggaaccaagacggggaggtaatgaactatgagtaagattgaatctgcccttcaagcggcacaaccgggactctctcggttacgtagtggcgctggtggtatgggctatcgtgcagcaaccactcaggccgaacagccaaggtcaagcctattggacaccattggtcggttcgctcaggctggtgccgatatgtataccgctaaggaacagagagcacgagacctagctgacgaacgctccaacgagattatacgtaagctgacccctgagcaacgccgagaggccctcaacaacgggacccttctgtatcaggatgacccatacgctatggaagcactccgagtaaagactggtcgtaacgctgcgtaccttgtggacgatgacgttatgcagaagattaaagagggtgtcttccgtactcgtgaagaaatggaagagtatcgtcacagccgtcttcaagatggtgctaaggcatacgctgagcagtttggtattgaccctgatgacgttgactatcagcgtggtttcaatggggacattacagagcgtaacatctcgctgtatggtgcgcatgataacttcttgagccagcaagctcagaagggtgccatcatgaacagccgagtggaactcaacagtgtccttcaagaccctgatatgcttcgtcgcccagactctgcggacttctttgagaagtacatcgacaacggtctggttactggggcaatcccgtctgatgctcaagccacacagcttataagtcaagcgttcagtgatgcttctagccgtgctggtggtgctgacttcctgatgcgagtcggtgacaagaaggtaacactcaacggcgccaccacgacttaccgagagttgatgggtgaagaacagtggaatgctctcatggtcacagcacaacgttctcagtttgagaatgacgctaagctgaacgagcagtaccgcttgaagattaactctgcgctgaaccaagaggaccctcgtactgcgtgggagatgcttcaaggtatcaaggctgaactcgataaggttcaacctgatgagcagatgacaccacaacgtgagtggctaatctccgcacaggaacaagttcagaatcagatgaacgcgtggacgaaggctcaagccaaagctctggatgactcaatgaagtctatgaacaaacttgacgtaatcgacaagcagttccagaagcgaatcaatggtgagtgggtatcaacggacttcaaggatatgccaacaaacgagaacactggtgagttcaaacatagcgatatggttaactacgccaataagaagctcgcggagattgaccgcatggacataccagatagcgccaaggacatgatgaagctgaaataccttcaagctgactctaaggacggagcattccgtacagcaatcggaactatggtgacagatgctggtcaagagtggtctgccgctgtgattaacggtaagttaccagaacgaaccccagctatggatgctctacgcagaatccgtaatgccgaccctcagttgattgccgctctgtatcctgaccaagctgagttattcctgacgatggacatgatggacaagcaaggtattgaccctcaggttattcttgatgctgaccgactgactgccaaacgttccaaagagcaacgcttcgaggatgataaagcattcgagtctgcactgaatggctctacggctcctgagattgctcgtatgccagcgtcacttcgtgaatctgcacgtaagatttatgactccgttaagtatcgctcgggtaacgaaagcatggctatggagcagatgaccaagttccttaaggaatctacctacacgttcactggtgatgatgttgatggtgataccattggtgtgattcctaagaacataatgcaagtcaactctgacccgaaatcatgggagcaaggtcgtgatattcttgaggaagcacgtaagggaatcattgcgagcaacccgtggataaccaataagcaactgaccatgtattcccaaggtgactccatttaccttatggacaccactggtcaagtccgagtccgatatgacaaagagttactctcgaaggtctggagtgagaaccagaagaaactcgaagagaaagctcgtgagaaggctctggctgatgtgaacaagcgagcacctatagttgccgctacgaaggcccgtgaagctgctgctaaacgagtccgagagaaacgtaaacagactcctaagttcatctacggacgtaaggagtaactaaaggctacataaggaggccctaaatggataagtacgataagaacgtaccaagtgattatgatggtctgttccaaaaggcggctgatgccaacggggtctcttatgaccttttacgtaaagtcgcttggacggaatcacgatttgtaccaacagctaaatctaagactggaccattaggcatgatgcaatttaccaaggcaaccgctaaggcccttggtctgcgagttaccgatggtccagacgacgaccgactgaaccctgagttagccatcaatgctgccgctaagcaccttgcaggtctggtgggtaaattcgatggtgacgaactaaaagctgcccttgcgtacaaccaaggcgagggacgcttgggtaatccacaacttgaggcgtactctaagggagactttgcgtccatctctgaggaaggacgtaattacctgcgtaaccttctggatgtagctaagtcgccgatggctggacagttggaaacctttggaggtatcaccccaaagggtaaaggtattccggctgaggcaggattggttggaatcggtcatagtcagaaagtaacacaggaacttcctgagtccacaagttttgacgttaatggtatcgaacaggaggctccagcaaaaccattcgccaaggacttttgggagacccatggagaaacgcttgacgaatacaacagtcgttcaaccttcttcggattcaaaaatgctgccgaagctgaactctccaactcagtcgctgggatggctttccgtgctggtcgtatcgataatggttttgatgtgtttaaagacaccattacgccgactcgctggaactctcacatctggactccagaagagttagagaggattcgaaccgaggttaagaaccctgcgtacatcaacgtggtaactggcggttcccctgagaatcttgacgacctcattaagctggctaacgagaactttgagaatgactcccgcgctgctgaagctggcctaggtgctaaactgagtgctggtattattggtgctggtgtggaccctctaagctatgttcctatggtcggtgtcactggcaagggttttaaattaatcaataaggctcttgtagttggtgccgaaagtgctgctctgaacgttgcatccgaaggtctccgtacctccgtagctggtggtgatgcagactatgctggtgcggccttaggtggctttttgtttggcgctggtatgtctgcaatcagtgacgctgtagctgctggtctgaaacgtagcaaaccagaagctgagttcgataatgagttcattggtcctatgatgcgaatggaagcccgtgagacagcacgcaacgccaactctgcggacctctctcggatgaacactgagaacatgcagtttgaaggtgaacataacggtgtcccttatgaggacttaccgaccgagagaggtgccgtggtgttacatgatggctccgttctaagtgcaagcaacccaatcaaccctaagactctcaaagagttctcagaggttgaccctgagaaggctgcgcgaggaatcaaactggctgggttcaccgagattggcttgaagaccttggggtctgacgatgctgacatccgtagagtagctattgacctagttagatcccctactggtatgcagtctggtgcctcaggtaagttcggtgcaacagcttctgacatccatgagagacttcatggtacagaccagcgtacttacaatgacctgtacaaagcaatgtctgacgctatgaaagaccctgagttctctactggtggcgctaagatgtcccgtgaagaaactcgctacactatctaccgtagagcagcactagccattgagcgtccagaactacagaaggtactcactccgtctgagagaatcgttatggacatcattaagcgtcactttgacaccaagcgtgaacttatggagaatccggcaatcttcggcaatacgaaggctgtgagtatctttcctgagagtcgtcataagggaacctacgttcctcacgtatacgaccgtcacgccaaggcgctgatgattcaacgctacggtgccgaaggtttacaggaaggtattgctcgttcgtggatgaacagctatgtctccagaccagaggtcaaggcccgagtcgatgagatgcttaaggaagtacacggggttaaggaagtaacgccagagatggtagagaagtatgcgatggataaggcatacggtatctcccattcagacaagttcaccaatagttccataatcgaagagaacattgagggattagtaggtattgagaacaactcattccttgaggcacgtaacttgtttgattcggacctatccatcacgatgccagacggacagcaattctcagtgaacgacctaagggacttcgatatgttccgcatcatgccagcgtatgaccgccgtatcaatggtgacatcgccatcatggggtctactggtaaaaccactaaggaacttaaggatgagattttggctctcaaagcgaaagctgagggagacggtaagaagactagtgaggtacatgctcttatggataccgttaagattcttactggtcgtgctagacgaaatcaggacactgtgtgggaaacctcactgcgttccatcaatgacctagggttcttcgctaagaacgcctacatgggtgctcagaaccttacggagattgctgggatgattgccactggtaacgtgcgtgctcttggtcacggtatcccaattctgcgtgataccctctacaaatctaaaccagtttctgctaaggagctcaaggaactccatgcgtctctgttcgggaaggaggtggaccagttgattcgacctaaacgtgctgacattgtgcagcgcctaagggaagcaactgataccggacctgctgtggcgaacatcgtagggaccttgaagtattccacacaggaactggctgctcgctctccgtggactaagatgctgaacggaaccactaactaccttctggatgctgcgcgtcaagggatgcttggagatgttattagtgccaccctaacaggtaagactacccgctgggagaaagaaggattccttcgtggtgcctccgtaactcctgagcagatggctggcatcaagtctctaatcaaggaacatatggtacgtggtgaggacgggaagtttaccgtcaaggacaagcaagcgttctctatggacccccgtgctatggacttatggcgactggctgacaaggtagctgatgaggcaatgctgcgtccgcataaggtgtccttacaggattcccatgcgttcggggcactgggtaaaatggtgatgcagtttaaatctttcaccatcaaatcccttaactctaagttcgtgagaaccttctacgatggctacaagaacaaccgagcgattgacgctgcgctgactggtatcatctctatgggtctcgctggtggttactacgctatggctgcacacgtcaaagcatatggaatgcctaaggagaaacgtaaagagtacttggagcgagcactggacccaaccatgattgctcacgcttcgttgtctcgtagttcccatttaggcgctcctttggctatggctgacctagttggcggtgttttagggttcgagtcctccaagatggctcgctccacgattctgcctaaggacaccatgaaggaacgtgacccaaacaaaccgtacacctcaagagaggtaatgggggctatgggttcgaaccttctggagcagatgccttctgctggctttgtggctaacgtaggggctaccttgatgaatgctgctggtgtggttaactcacccaacaaggcaactgagcaggacttcatgacaggcttgatgaactctaccaaagagttggtccctaacgaccctcttactcagcagcttgttatgaaaatttatgaggccaatggtgttaacttgagggagcgtcggaaataatacgactcactatagggagaggacatcttctccctgtagtctcttagatttactttaaggaggtcaaatggctaacgtaattaaaaccgttttgacttaccagttagatggctccaatcgtgattttaatatcccgtttgagtatctagctcgtaagttcgtagtggtaactcttatcggtgtagaccgcaaggtccttacgattaatacagactaccgttttgctacgcgtactaccatctcactgaccaaggcttggggtccagcggatggctacacgaccatcgagttacgtcgagtaacctccacgaccgacagattggttgactttacggacggctcaatcctccgtgcgtatgaccttaacgttgctcagattcaaacgatgcacgtagcggaagaggctcgtgaccttactgctgataccatcggtgtcaataatgatggtcacttggatgcgcgtggtcgtcgaattgtgaacctagcgaacgctgtggacgaccgtgacgctgttccgtttggtcaacttaagaccatgaaccagaactcatggcaggtgcgcaatgaggccctacagttccgtaatgaggctgagactttcagaaatcaagcggagggctttaagaacgagtccagcactaacgctacgaataccaatcagtggcgcaatgaggctgaggggttccgtaatgaggctgaacagttcaagaacactgctggtcaatatgcgacatctgctggtaactctgctaccgctgcgcaccaatctgaggtaaatgctggtaactcagctacggcctcagcggattctgcggcttcttcaaaacagcaagcagaccgagcgaagcaggaggcagacaagctgggtaactggaatgcacttgcaggtgccattgaggaagtaagtccagaccatgttgtttcatgggcggctactgctaagtttaacggtgaacttattgctaagcgttcttcaaccctgagggcaactgccgaagctggctctatagggcagatggtccacgagtatgaccctgctgagggacagtatgtatcaaatacgttttgggcaattaagcacccgcatcgaagtgactggcacgttccctttcagatcacgagtaaagccaatgattcggctacgtgggatacgcacttcggggacttcatgcattgctacaatggattgcaggtagaaggatacaataaaccactaggtgtcactaatcaggctaatactgccgtgaaaacggtagcatatggtccgggagatttagtccaaggtgcgtgggtatgtaacaccagatggagtttctacgacgcagggttagaaattggatgggttcgcggtggctctactaacggaaatggcctaatcaggtggaaaccggaaggaactcaggctacgtattacgatatttggttaaatccaggcggcttggtgcaattcccaactacgatcaaggtaggtggtgcctcaatggcagttgatggtaacattggtggctctatctggggtgatcatctatacggctggcttagaacaaacacagttaaccacattgcgatgggtgaggttaactgggcacagctatggagggctggaggtgttgaggatggtggcggtaaggtaataactggtattgcaaacccgaacggagatgacctgatagatggttgtcagtggcgcgtaatgcagtatgttcgcaacgacggtcaacgatttaatatctactaaaggagacacactatgaagactttgcgtcactataagaacttcgtaaattatgtcccagtgcgcacaaaagagaatgcggaccttctagaccacggtgtaggtttctcaaaggatgagaacggaaatgactggtatgaactacgtaagacattccgtgatgatacgtggaaacttgtctacgccaaagacggctcagttatccagtgcgaacaggatgttcaggagttagccattcagggttctgctggcgttgttgaacttgaggaaatccccgccgaatactctcggtacaacatgatgcagtggtggtgggacggtgagaagctcacttggtgtcctcggtactttgagaaccagaaggctcgtctaatctctatggcctccaagaagattgagcagtatgctgacttcatggcacttggggaggaagggttagaagggatcctaaacgcgtggcgagtctatcgacttgctgtgtataaggtagacctgagtgttctgcctttctatgactggcctgagaagccggaggacttctaacaaccacacaaggaaagacgtgtagtccacggagggactcatttagggaggatacatgttgtctttagattttaacaatgagttagtcaaggccgcaccaattgttggtacaggtgtggctgatggcgctgcgaggcttttcttcgggcttagtcttaatgagtggttctatgttgccgctatcgcctatacagtggttcagattggtgccaaggtagtcgataagatgattgactggaagaaagccaataaggagtgatacgtatggaaaaggataagagccttattacgttcttagagatgttggacactgcgatggctcagcgaatgcttgctgaccttgcggaccctgagcgtcgttctccacaactctataacgccattaacaaactactagaccgccacaagttccagattggtaagttgcagccggatgttcacatcttgggtggccttgctggtgctcttgaagagtacaaagagaaagtcggtgataacggtcttacggatgacgatatttacacattacagtgatatactcaaggccactatatgtagtggtctttatggatgtcattgtctatacgagatgctcctacgtgaaatctgaaattaacgggaggcattatgctgcaatttttacgtaagctggtcccttgggttctcgctgggatgctattcggatggggatggcaccttgggtcagactcaatggacgctaaatggaaacaggaggtacataatgagtacgttaagagagttgaggctacggcgagcactcaaagagcaatcaatgaaatatcggctaagtatcaagaagaccttgccgcgctggaagggagcactgataggattatttctgatttgcgtagcgacaataagcggctgcgtgtcagagtcaaaactaccggaacctccgatggtcagtgtggattcgagcctgatggtcgagccgaacttgacgaccgagatgctaagcgtattctcgcagtgacccagaagggtgacgcatggattcgtgcgttacaggatactattcgtgaactgcaacgtaagcaggaaaacaagtaaggaggcaacgtgtctactcaagccaatcgtaatgcgctcgtagtggcgcaactgaaaggagacttcgtggcgttcctgttcgttttatggaaggcgttaaaccttccggtgcccactaagtgccagattgacatggctaaggtgctggcgaatggagacaacaagaagttcatcctacaggctttccgtggtatcggtaagtcgttcatcacatgtgcgttcgttgtgtggtccttatggagagaccctcagttgaagatactcattgtatcagcctctaaggaacgtgcagacgctaactccatattcattaagaacatcattgacctgctgccgttcctcgctgagttaaagccaagacccggtcagcgcgactctgtaatcagctttgacgttggcccagctaagcctgaccactctcctagtgtaaaatcagtaggtatcactggtcagttaacgggtagccgtgctgacattatcattgcggatgacgttgagattccgtctaacagtgcaactatgggtgcccgtgagaagctatggactctggttcaggagttcgctgcgttacttaagccgctgccttcctctcgcgttatctaccttggtacgcctcagaccgagatgactctctataaggaacttgaggataaccgtgggtatacaaccattatctggcctgctctgtacccaaggacgcgtgaagagaacctctattactcacagcgtcttgctcctatgctgcgctctgagtacgatgagaaccctgaggccctcgctgggactcctacagaccctgtgcgcttcgaccgtgatgatctccgtgagcgtgagctggaatacggtaaggctggcttcaccctacagttcatgcttaacccgaacctgagtgatgccgagaagtaccctttgaggctccgtgacgctatcgtagcggccttagacttagagaaggcaccaatgcattaccagtggcttccgaaccgtcagaacatcattgaggaccttcctaacgttggccttaagggtgatgacctgcatacctatcacgattgctccaacaactcgggtcagtaccaacagaagattctggtcattgaccctagtggtcgcggtaaggacgaaacaggttacgctgtgctgtacaccctgaacggttacatctaccttatggaagctggaggtttccgtgatggttactcggataagaccattgagttgctcgctaagaaagcgaagcaatggggagtccagacggttgtctacgagagtaacttcggtgacggtatgtttggtaaggtattcagtcctattcttcttaaacaccacaactgcgctatggaagagattcgtgcccgtggtatgaaggagatgcgtatttgtgatacccttgagccagtcatgcagactcaccgccttgtcattcgtgatgaggtcattagggccgactaccagtccgctcgtgacgtagacggtaagcatgacgttaagtactcactgttctaccagatgacccgtatcactcgtgagaaaggtgctctggctcatgatgaccgattggatgcccttgcgttaggcattgagtatctccgtgagtccatgcagttggattccgttaaggtcgaaggtgaagtacttgctgacttccttgaggagcacatgatgcgccctacggtagctgctacgcatatcattgagatgtctgtgggaggagttgatgtgtactctgaggacgatgagggttacggtacgtctttcattgagtggtgatttattaggccaaggagggccattaaggaggtaatatgataagtaataagaagtatacagttgataaggatactggctgctggaactttaagggatgtaagacgaagactggctatggtcgtctacgtgtaaatggagtccattggatggctcacaggtattccctgagttgtcatctaggcagaccgatagctgatggaatggttgtgatgcacctatgtgataacccgtcatgtgtcaaccctgagcatcttaaggaagggactcagaaggagaacatagaggactgcatccagaaagggcgcgcaacaaaggccacaggtaaacgcgatgtgtctaagagagaccctagcgaggaacgtaaagctatagtgattcgtagataccataaaggatggaccgcaacgtccatagccagatatcataagctctctgtggcgtgggtcaagagggtcattgaggcttacctaagtgattgatatttgaaattagtgatacaggtctaagtatatgattccagaccattattctaattcgactcactatagggagaagcctacctaaagataactataagacttaaagtgtcctataaggtaggttgttactattgttaatacaaccaacataaagggaggagactcatgttccgcttattgttgaccttgttgcggcatagagtcacctaccgatttcttgtggtactttgtgctgcccttgggtacgcatctcttactggagacctcagttcactggagtctgccgtttgctctctactcacttgtagtgattagggtcttcctgaccgactgatggctcaccgagggattcagcggtatgattgcatcacaccacttcatccctatatagtcaagtcc

SEQ ID NO: 13 - DNA, 70861 bp, artificial sequence
  BP1197
tggtggggctacaccccttacaccataagcacccccccctgtctttactagtgtagccttagcctaccccaccttgtacacgttacacgttgcttcgcaacttatggacatgttgtccatatcttatcaatcaactattggagactaatactatgactactcaggctaacgttcgtatgactgtaggaactctgttgggtactgttaacgaagcagcaactactgtagctgatacattcggtactgctactaaagcagtaggtatgcttaatcgttatgtaactaaacaagcagataaacaaatcattcgtgacaaattagaaatgcatgagtttaccaataaacttattgaggaaactgcaatgcaagaagctattcgtcagaaacaaatcttagacttctgcaaagatgaacaaaacaaagaattgttctctaatgcctatgaccgtcttagcaaaatcttagcagactctaaataataacaaacaaatggaggctcctcggagtctccttttacatagaaccgatagttcaataactatctactttaaagataagaagctccgcttcttttggatgaagtaatgcatccaatcctgtatgaaatcttaaccttttgtctgggattacttaccgacaaagtagtctcaactaatcaaaatcaactatctggagagtacaaaatggctatcactacttttgctaaaacttttggtcaggcttctactaaaactgaatccaacaatggttctcgtccgaaagctcagttctggattaacgttggctatgtagctaatgaaggcactgaagatgaacgtttcatctctctacctactggtattccactggatactcaggaacatctgccaaccaattcctctaacgaagacttccgtgcaatgcgttgtgcacagaacgatttgttagatcaactgatggaatttgctaagactctggaaccaggtcaggacggggttatctcactgcaagttcaacttcgtcgagttaatgaagaagctcctgctatctcagcaagtgagaataaatatgctcgtaaactgactttctaatctctataggactaccttcgggtagtcctttttaattttaactatctaaatactaaagtagagattttgacccttttcgacgaagggatactaaaaagtaatggatagtttgagcagatgttttagaagaaggaatatacagatgcaccctcttataaaacggttcctgatggactatcaggagtggttagataatggagccagtgaacctcactacctgtttgataggggtagtgggctatgtgttcaactaggtaaatatcttagaagacagccaatcagtgaagaaacagtagatgctctgtgtaagagctttactcatttacttcctgataatgataccaatctaccattcaatgtagatgttctcgactacatgatggagtgttctgatggaagatgtcatctgaaccaaagtcgaattacttggattaagagtcagttggagagtaagtaaattatgtcatatgaaattgtaaaacattggacttctaaggctggtctgaaggcttgggtattgctggtaaatggtggtagtcatcattgtggttatgtggaaataccagaagcattactggataaaaacttctatgactatatctgtgatgatgaagaaacacttcatattgcagtacatggtggagttacctatcaaggtgtccctcagtggactgatgggattaaagtcataggttatgactgtgcccatgcaggggataaactgaaatgtcctaaacaattcattggctccattagggagaaactctatgaggattcttatggagtatggcgagatgaagaatactgcatcaatgaatgtgaaagcatggcagaccagttaattaacctgataccaaaattagggtttaacgatgaaattcagaacagtaatggttaatgctcttgataccagaggcaatgaaatcattagctataaagtgcaaggctttaaatggttcaaatggaaaacattaactagctttaaagaatttgagaaagataaagctattaagttaaccaagaaattgaaccaacgtaaaaagattaaattagttactgtaattaaataaggataaggcaatgcgtaaatcactaatcatggggactaaagaagacgttgctaagatgaaagctaaacgtcagatgaataaagcagtaacgtttgcagaacgttatagtacgtctgaaccagtacgtcgtattgttactttcaatcatccagctattaagggtatgtaatgcaaactaaagataagaaagacttagaacgtcttctccgtgtatatggtgattatgcattattagcagaaataactaatattatcgaagaagactgtcgtaagggttatgccaataacccacaagcaataattcatcgtgatgcagtagtgcttagagaagcagtcagtaagatgcaggcattacatccattaagacaacgagcataaataggagggggctactaagccctcttcttatttttatcgtggttattaagcaactatcttagaggaaggaataatggaacaattaaactacggttataagattaaacgcaatcaagtaagaggttcttggttatttatcatttatggtaagccaatctatgaattacatcgtggagagaaatccaagacctattacgtaactcatattgctacaggaaagactcctgcatgtgcaggattgcttcgtgatgcaattatgaaagcatgtatgttagaaggacttctatgaaccaaatcattgctatcccgcagcataaagctcgtattgctgacaggaatattcgtattcattatccaatgcctttgagcaatccatttcagaaaaatgagagaaccacggatgaagatatagcagcagcttatgaggcatatcttcgtaaccgtttggtaagtggtgataagctcattacggctgaaatggaacgaattgctaaattcgttatggatgatactgacaaaccagttggcctcattggtaatgaactggaagtgaatgtaatccgtaagattattatggaggctcttaatgggaatcagtgaatcccaggctatggctattaaacagttagccttcaactgccttagtgctatgaaggcatttaatgaagcaaaaactttccctgaccagaataaagctcgtattcgactttatcagtctaagaaagattttgaagaatatctggaaagtattatggtgagataatgaaaacaatattaattgttcatgatgctgattttaatgatgtcgataaaatgatgcgtaatattgattatgtagctcagacaactccagcatttaaagaagaatttactctgtactgtgatgctaattcaccattagtccctattctgaaagaagccggtttacccttctatacagataatttccctaaagaacctgattatgtaatttcatttatttatgacttacacgatggctcagaaccaagtgaattggctatgagtcaatggaaatccagaagacctgtatatgcatttcaggttgttaaatcaaggggttaactatgttaggtaataacactaatgctctgtttggagtatcagccagacctattatcattgttaataaacatcacggtaagaagggtgaatatattggacgtggttctcctctaggtaatccattcgttattggcaaagatggaaccagagaagaagtaattgccaaatataaagtatggctacaagaacagattgataaaggtaatccagttgtactggatgaattaaatcgtcttggtaataaagccattgatgaaaaaggattagctttacagtgcttctgttatccaaaaccttgtcatggcgaggttattaaagagaagttagtaaaagctatgtataactactttgtggaaaatcctaatggataaacaatgcaaatgtggtaaaggctatgtatcccaatgggatggtaagtgcggtcattgtagaaccaagaaagaacaacgtgaccacgaatatgcacttcaggaaatgattgtgcctgttgagaatttaggtatggctccacttgaagcttacaaatacataaggagattatgcaaatgaaagaagtattcgtatttggttctaaccttgctggtgtacatggtgctggtgctgcaaagacagcatataagaaacatggagccagatggggtaaagggcatggtcattacggtgacagctatgccattcccactaaagataccaatatcaaaacgatggctattgaagacattcgtacatttgtaaatgccttcattgtctatgctgctaatcatccagaacttaactttaaagttactcgtgtgggttgtggattagctggtattgatgattctgttatggcctctatgtttgaaaatgccactggtaactgttcctttgacttagcatggaaaagctacttaggggatgatttcaactactggggaacgttctaactcatacgttaggcaataagctgctccgcagcttttggtaattaatatgtttaaccaattttggagaatatgcgatgtctactatcgaacatcagatgcacctcgaaaagctgtacaacaagaaccaactgttaccaagaatgcgtcaggagtttgaagaaaactctggtattgatttcaaagccttctttgcacatataggcattgattacaaatttggcattgatgcaatggttcaaatggctctgcataagcgagctgacctaccaacattagttggtacattgcgtcatcactgcaaatctgcacaggaagtagcagacaacctttttaagatggcaagtgaggattgctttaactttgatccgaccatcgacaagttcattgtcatttatacaatcagcgatgacgtacagcatgaactggattcatttcagtatccattacctatggtagtacgtcctaagctactaactaagaattatggtactgggtacttcacatgtaataagagtgtgattcttaagaagaaccatactgacgatgacatctgcttagaccacctgaaccgtatgaacaagattccattgtctatcaattgggatgtagctcatatggttaaaaatgaatgggctaatctggataaaccgaaagaaggtgaaactcgtcaggagtttgaaaaacgtgtacgtgcattccagaaatacgaccgtactgcacatgaagtaatgggtttattgacccaggaaggcaataagttctatctgactcatcgtccggataaacgtggtcgtacctattctcagggataccatgtgaactaccagggaaccagttggaacaaggctgtccttgaatttgctgaaaaagaagtaattgattaagtaatccattaatgcaagccaataggctaagacgcgaggaatatacaatgcaaacttttactgcccgtgaatatctgaaaattgacattgctaataactatggtctggataaagaagactgggatgaccgtattgcatggttcgataagaatgagaacaacctactgaaccttgtaagagaagctgaagaaccagccctgttctacgccggtgttaaagcatggatggacgttaaggaaggtaagccaattggttatcctgttgcactggatgctacatcatctggtctacagattctggcttgtctgactggtgaccgtagagctgctgaactatgtaacgttgttaactatcgtgatgaaagtggcaaagttaaacgtcgtgatgcttatacagttatctacaacaagatgctgaacactcttggtaaaggtgctcgtatcaaacgtaatgactgtaaacaagcaatcatgactgctctgtatggttcagaagctaaaccaaaggaagtatttggtgaaggcattatgctcaacgtatttgaaagcacaatgaatgtggaagcacctgctgtatgggaactgaataaattctggttacagtgtggtaatccagaggctttcgtatatcactgggtaatgccagatggctttaacgtatatatcaaagtaatggtaaatgaagtggagactgtccacttcttagataagccatatgactgtgttcgtaaagtacaaggtactgaagagaagactcgtatgctatctgccaataccactcactctattgatggcctagtagtacgtgagctggttcgtcgttgtgattatgacaagaaccagattgaatacatcaaggctctttgcaatggtgaagctgaatataaggcttctgaaaagaactatggcaaagcaatggaactgtggggctattatgagaagacaggattcctgactgctcgtatctttgattatctggattctgaaactattaaattagtaaatactcaggacattctagacctgattgaatccatgcctaagaagccattccatgtactcactgtacatgactgcttccgttgcctgcctaactatggcaatgacattcgtcgtcagtacaacaacttgttagctactattgctaaaggcgacttactctctttcattatgagccaggttctaggccaagaagttactattggcaaactagacccgactctatgggaagatgtattagaaaccgaatacgctctatcttaataactaaggctatccctacgggggtagcctttatttttttagtaaatcataatggataggcatttaacctatgaggaaattaaaatgcctgttcttaaagtgatgtttcataaagataccaacgtagctactgtactggatgccagtggtagccttagtgatggttccgttgaggtgggtactttccatcaccctgatgaaacgtatcccgatagtgtaactatctatcatggtgtccgtgacctgctgtataaacgcagtgctaaagacccatctcaaactgcttcttacccaaataacattatcaatatgcaagttatcagtattgatatgaaggcaactcctcgcttgattctgggtactgcattgcctcgtgtaatctctactattgaaggtaaagatgtaacctggcatgtagatgttgctggtggtaaagcaccattgacttacaagtggcagtttaaagctaatactgtaggtgctgctttcgctgatattgattccggagagaatcctacagctaaaactgcaactcttattaaccatgcagtaactgctgaatctgctggtacttataaagtcatcgttactgatgctaacggtactactatcgagagttcttctctgctggttgtaggagttcaggaaccacctgaagtagcttctattgttgcttacccaagtccactggctctatcagtggctgatgatattactgaaggtaaaacagttaagttttcttccctgcctgctggctctttgattggtactctgtccattaagacccagcctgacagtggtaaagctactgctgagattagtggtaatgtactgacagttaaacctgtagccgcaggtgacactactgtagtagtcaccaacggaaccaaggaagtaactgttacggttaatgttacagagtaatgtgattgtttttatgaatgtagccctccttgtgagggctttttagtatctataggagagtaaataattatggctaataagaactgtcttcgtgtatggcatatccctcaagtacccggcaaagccttctatgttgaagtagattcagtagaagaaggtgtacgtatcattgatatactagccaactatgacctattccagtatgagaacaatatcaaaggtgattactgcaatgtctctggtttacagatgtatgatgaacatatcactgatgatgaaatggaagagatgggtctgactgaccgttgggtagactggtactatgaagatgaccagagcttttttgataacccgaaagagtatttgaataatctcaagaagtaatttcttggggttaatgacccttattaattccttatcctttgccctcctatggagggcttttttacggagtacaaatgtttaagttcttagaccttatctgggcagtcattttgctggttgctacaggctttgtatatggcttcttgctcccatcaatgatgtctgctttagacagcatcattgttgttatgggcttgatagtctgtattgtgtggcctcttatcgtaggccgtatcgtttatcttacagttaagaaaaggatgagaagaaaacatgtataagtacattgcagtagcaattgcaggactaatcattgctctgagtttaacgagctgctatgaccgagttgaaccaggtaatgtgggtattatcgttaaccgcctcggtgaagataaaggcgtggaaaatgaagttaaaggtgtaggccgttactggctcacttggaatgaagaactctatacattcccgacctttaagcagatgaagacctatgatggtctgttctacttccaactgtctgatggtactcagataggccaccagatggctatcagctataaagtgaatcctactaaggtaactaatatcttccagacgtatcgtaagggggttaatgaaattaccgagcaggatttacgccaacgtattgctgatgtacttaacagacagggtaacctgattaacaccgatacatttattgatggtggtaaatctaagttactggatagtgtcactgacacaatccgtaaagagatggaaccagtggggattgatattattgctatctcctggattggtgctcctgaataccctgataacgttaaacgtgccattaatgccaaagtagaagctactcagaaaactctgcaacgtgagcaagagattcagcaacgcgtagctgaggctaatatggaacgtgaacaagctaagggtgtagcagatgctattctgattaaggctaaagcagaggctgatgctattcgtttacgtggtgaagcactcaccgagaacccaaatgtaatgcaactggaagccattaataagtggaatggtacattacctaccacaatgattcctggggctactacacctttcgttaatgtgaaataactaagcaaacccaccattacggtgggtttattttttgaagttatctaacactggatattcctatgaaagtaaatgttttacgtcgtaagaaagttcctttctttcaaatcaattgtggttcatgttttcaacatgatgatgactactatatgaagtgtagttatcaatctaaagaacacttctatggtgtgaatttacaaacaggtcatctgttcacatttgataataatgactttgtttaccctgtgactttagaagcatgtattcctgacccacttaataaatagtatggctcaagaaaagaatcgtcgtcagacacttatcgaacgtattcaggccagaatcaaattacaggacttaggctataccgttaatggtcagcctagtctctgtcacatctggactggctcacattcaggtaatgggcgtggtgggcaatatggcaggatttccgtgaatggagttacctctgcaactcacattattgcctatacccattatcatggttatatccccaataagatgcaagtagaccatctctgtaataatcgtctgtgctgtaaccctgaacatcttgaattggttactcaccaagagaaccagagaagaagggctaagcgttctaaatctaaaggaaataaataaatgattaaaaaacttatttgtaaacttattgcagcaatcttaattagtattattggtattgcatgggtaatttctactccagataacgttatgcaacaaatttattatgctgtgtatacatcaacctcttttgtttgggtttatgtaatgtaccgtatttgcagcgactaatacttaatatagcttaactggagagtaaaatggctagtattgattctattgccgtatgtaatccacggcaggtacgtaaatttgttgaacactgtatccgttcaggattggttccatttatcacctcatcccctggcatgggtaaatctgcaattgtccatcagattgcagaagactttggcctgaaactgattgaccatcgtctgtctacttcagcaccagaagacctgtcaggtctacctcgttttaaagagaatggtcgtgctgaatttgctccatttgacgagctattcccattggaaggggatgctgtacctgaaggatttaatggctggcttctctttctcgatgagtttaactctgctcgtaaagagattcaggctgctgcttataaactggtactcgaccgtatgactggtcagaagaagctacatccttatgtagctatcgtatgtgctggtaacaaagcaactgaccgtgccattactaacaatctgtctacagctatgcaatcacgtcttattcatctggaaatggagactgattttgacgtcttcatggaagatgtagctatccctaacaagtgggatgaacgtgtaattgcattcctgaatgctaacccaaataaactgaatgattttgaaccagaccatcaagagaagactttctgttgttctcgtacatgggagttcgttaacaagattgtttccattctcccaccaggaccaattgatagtgaaatgactctactgttagcaggcactatcacttctggtgtagcaacatcattcgtccagtttactcaggtctatagcaacatggtgtctttgaatgagattctggataatcctaagaaagctcgtatgcctgaagacaataacctgttgtgggctgtagtcacttcactgattaacaatactgacgaagataatcattcgaaaatctttgattacattgaacgtatgccatttacgttcaaggttttgtactaccgttctgtaggtagtctggttccagctttggttaaattaccgaactggcgtgttgctgcaatcacattatctaaatacgttcatggttccaattaacaaaaaaggagttacagacctcctgtatgttgctggctttaacggtgaagaaattaccgtatatgccccaagtctggctgctgctaaacaaaaggcagttgaatactttcgtccaaagaaacgtgtaacccataccatttgggttcatctcgcagaggaaaactgatatgtccatgacagatgctcaattaacccgtgaatatgacagatgtcaggctaaagcctttatgggcaaaactgctgcattctttggttcactgttatgttctctgaagttccgttgggtaaaagatggctgtgatacagcacaaaccgatggtgagcatctcgaatggaatcctgattggtttgaaagtctattacctgaatctcgtgtaacagtacttatgcatgaactatggcatgtcggcttactgcattctgttcgtatgggttctcgtgacccagaagtatggaattatgcctgtgatatttatatcaacaatcagcttattcaggatggctacagctttataggaatcgaaaattgctggaaagaccctaagtatgctggttgggctgaagaacaaatctatgatgacctcatgagcaaacagatgcgtcctcctaaagcatttggtgcttttgggactggctcaggtggtgacatgaaaccttccacttcgaaggctagtcaggtaaatattgtcaataatgtagtaagagccatgcaccaacagaaactatctggtggtcctttgcctggggtattacctggaaaaatggaagaagttattactcaattcctgaaaccagtagtaccgtggcaggttttacttgaacgcttcttcaatgacctgcaagaaacttactactcatggcaacgacctaatcgtagataccctgatatgtacctaccatctcctatggatgatgacggtagactagaacatctggcttatttcctcgatacatctggctccattaaacctaaagatgctttacgctttagctctgaagtggcctatgtaaaagagaaatatcagcctcagaagatgactctagttcagttcactacagagattgtagatgagcaagtcattgaagatggtgataagtttactgatgtcactatcaaaggacggggtggtactagtctggttcctgtacgtgagtggattattaagcataagcctactgctgccattatctttactgacttagaagtcagaccgatggaaccattgccatttgatattcctgtcatatgggtagttattcgtaaccctggtgcacaagttccatttgggaaagttattaacattacatgaggttttatggttgttaatggaaaactattgttaggtgctatgcccattaagggcatggtcaacagtaaactcagttcaggtgagactacatttgggctaggggaagctggttatgacatccgtattaaacaggatgttaccttctaccgatttcttggtttgattccctgtatcaagattaaggatgaaggaaagaccaagtggaagtttggcactttcacattagcttctgcaatggaacgtttcaatgtacctgctggcctagtaggtattgtccatgacaaatctacatgggcaaggcgtacattatctgtattcaataccgttattgaaccaggatggtcaggctatctgactttagaactggtttatcacggtcgtaaaaaacttcatatccctgctggttcaggtattgctcaagtcatcttccatgagacagtagagaatactgcctacaatgggcgataccagaaccagcccaatcaacctgtagctgctaagtcagctcgttaattaaggaaatatcatgtctatctttactactaaggttaatggtcagaaagttactgttgttgctcgtaacgtagcttacgttactgaaaacagtgaaggccgtggtgtaattacttttactaacggtgattccattgacacccaggtaggttatgactctatccgtcgtaacgtagctaaagcacttgatggtgctaaagacaccgcagagtaaggtgtttacagtaatggggttatacagtagccccatttatggaaattcctctctctccattgcttagtcccaactatgcccactttatgtgggcttttttaattagagactatgtatgagcaaactaggtatacacgtttacatagatgaagccgagaagatatacccctatatattatttagttccagtgatttacttcagatgaaggtaaactccatcatcgtaaactactggtataacgataagaattgggattactgggctgcacgacagaagagtaagaacaagaaagatatattcaaaagcaaatcaactccacatatgtttccttggtatcacagaaaccggagatattgatgacaagaataccatttttaaaacctagaaaacgaacaccaaagctgtatcaaaagacttcagaagacggtttagccttgaaccagaaagctattaaggccgttagtacactggttcaaggtaaacaggatgctgttgctttacgtcttgttgttgagcaaatcttagttgctctggcactggctcaggtagctaaacaagaaggtaaacaagaaacctgtaaaacagcattaggtgctttgtactggttgtataaagaccttgctgacaactttgaaatgtctatggataagtggcagggcatttcttgtgtacttgctcttagagaaggacaggaattgctgtctactctaccaaaagcagaatttaaactagcctacactggagcacataagattgttcttggttccagtaaggacatctttaaccacctcaagttattcaaggctttctatgattaatgcaaaaatcctcgctgatagtattactctttctggtgaccgcctggtaacaatggaactggtttatccgcgtttcattcattcagaatttatgactcaccgagcacttaatcgtaatgcttccagtagtcgtgctattcctacccaacgccttattgagcaagttcgtaatgaaccagtaatgccagtacattggggtaagaaccagaaaggaatgcaggcaagtgaagaactcactcctatggagattaaggatgctgagttcatttgggaaaatgctgcctctgctgctgctgtgtatgctgaacaacttcgtcgcggacaagtacataagcagattgttaatcgtattctggaaccattcacgcatatccgtgtagtagtgacagctactcaatggaataacttctttggtttacgcattcatcccgatgctcaaccagagatttgtgaattggctactaagatgaaggaacagtatgaccaatcaaaaccccgtaccctgttggctggggaatggcatttgccgtacatcactaatagtgattacctcgatgcttacgattattgcaaacatcaacgaattactcgtgatgaaccaagtagtgatgagattaattgcctgttagtaaaaatctctgctgctcgttgtgctcgtgcttcctataacaactttaaaggtactccttctactatcgaagaagacctgcgtttgttctctaaattggttgaaagtaaacctgttcacgcaagtcctactgaacaccaagcaactcctcagcatgtaatgagtaaaggcttaaatgagcctactgacccatctacatgggaaaatggcattagtcacatggacagagatttacgtctatactcaggtaatctgtgtggctggattcaattccgtaagctgcttgcagatgaatgcatccactaagtaggtcttttgtgggtgtagaccactcataataaactccgctatttgcctcctacatggaggcaatttttttgattccatgtacataggaggccatatggttaaaccacgtaaattccgtattaaggataagcctgtaatgggtagtgctgctggtcagtcacatgagaaaggggacattgtttatgaatgccttcagtatgattacggcgttgctcatgatgacactcgtgctactggtgtcccacatacctcagtaactcttgaggaagatggtagttacccattcttcactgttcctactcataacctggaagaaattcatgattgacccaaatatcatccatgccaaaacaggcgaatcccataagctgtctgaatattccaaagtagaagatattgcagtttgtcctgcaaatattgcttctctttgtatctgtattgcagagctatctaaagaacgccaactatggctatctcctaataaaacaatggttcaggcaggtctggcagaagtacaacgtatgctggatgaatggtctgaagaccagatgttcattgatggcaatgcagaagcaataaccgatgatatggcctctgatatggctgtgtttgtattacaagcaatggctgaaaagcgtagtagttaattaataatttactggagaaaattcgatgcaagtagttgactctactgaactgaccacatcagcaacgttgggtgctcaagatgctatggccttcggtatttctgaagacccagcattcttccaaatactcagtgctaacctctattctaatcagaaactggcaatggtacgtgagacattgtgcaatagctgggatgctcatattgaggggaataaaacagatattcctatccatgtaaccattgataaagatggtttccttgtcttccgtgactatggttctggtattcctaaagataagattcaagaggtctatggggtatatggtgcatctaccaagaaagctaatactgcttccactggtggctttggcttaggatgtaaatcccctatggcctatacagacagttttactgtcacatctatgtgtgacggaaccaagactgtctatcacattgctaaatcttctgttgagactaacggtaaaccagggattattcctatcgttagcgtacctactgaagaatcagggcttgaagttaaaattcagcttcagtcagaagatgttttagaaattgattcatatattcgagccattgtattacatggcgagattaaatgtatttactgcaatcagtatacaggaccaaatacagtagagttattgcctgtactgagcatgtcttttgaaccaggtagctataacctagaccataacacatggcataaatattacatgggcagtcattcaatatttatccgttatggcaatgttatgtatcctgctttggacacccctgctacacatgaagcattaaaactggttaaacagtttatgcaggttattaactgtagccgtatcgttgttcaagctgccccatcatcactagctgtagcacctagccgtgaaacactgtcatctcaaaaaatgaccgaagatggtattgtaaatttggctgtagctttagtagataaaatggaagcagatattaaagctcgtcttccaaatgctattgaatatattgggaaagctattaaagaatatagccctcaccgttttgaggtaaatagttatttgccttacaccaatttagtgcctgatgttattgtcagtcgttacatgtcctctactttattcagtaagcaatatgctcatctgtgtaagaaatggggaaatatggaaattgaccgtcagcttgaacatcctgcactggctcatttctctggttctcaaaaagcccatctccgtaagcatttaaagagggctaaggatttacgtaattacagggaattaactaaagtatttactgatatggctattaagccgatgttcaaaacctttgctaaattgggaattactaaaggtatttctctatttcattatcaatatggtgttgaactgtggcgtaataatattgttaatagtgtccgtagaatacactcattaaacttcatgacttatagttctaagaagtgccgtgtatttgttaccccacgtattaccaatattgaagatagtctggctgggtatcccgaatttgataatctttctaccgagacactggtgaaatataactcaatcattatcaaagttggaaccaagaaaggtgaagcagaggctatgactaatctgctcactaaagcaggatacgaagtcattaatatggctgaatatcatgaatgggattgtatagctcgtagacgtaaagaggaacaagaagctaaattagccatttccaaattacaagctaagaaagctgctaataagaaaaaggtcagtcctaatcgtcttattagtatgaatatccttgaaataccaaaagagcatcgtagctattcaagtgaggtatgtggttctcactacgcttctcgttctcatgaccgaatggttgatgtagatactcctcagtattacatcatgcaggaagatattaataactacacaggaaggcttggtgttctttctatgtggcaattaacccctgctaccattaaagctgtaactgttgtttgtcgtaataaaattgaacgtaataaagctattaagcgaggtgctgttcatttggatgaatggactgctccgtatattgcttcagttcttacatccaaacaattcattaagtatgtcactaaagaacgtcagaaaacgttaagtgatattggtatttactccaaacacctcagattactgagagaactggatattacatatgccccattgaaaggtctgcgttatgacccagaactggagaatgcttatctcttcttacaaagtagtagctaccctaagctacgtgcattgttagggaagggtctgattactgaagaagagtatcacttcctcagtgatgttgatgtgcattgcaagactttcagtaagtactcggaacttcgtaggataccgaagatgttccttgatattgatgctgggggttatatgttggctgcatgtactgtagacacattgcttcgtgaaatcgaacaattccctgaatcaatccctgcaatcaaactgcttgtaaaagctgctcttaaacggaatacagactgatgaaacgaaattatctcgccattattgccctgtcagtagacagtcgtaacctcaccctatggcaaccagatggttctactatggtcatcccccaaggggatgcccgtgtaccacgtattgttgctgaagcaaaagaaaagaatcttaccccagataagattatcgaagtggatgtcactatcgaagctcagattcgtcaggagtttctggacgctgaacgtgatacgggtggctttgttaaattcttccgtattaccaagaagaagctacaagagttcttcttaggggaagaggaagagcaagtccctcatgtatcacctgtggagttaggtgctaaaccaactgctttcaatgcttttattgctaatgctgtaggcaaaactcttgctgtacaacatgcatcattaaaagcacctgaaccagaaatgacggttactcatgagcgtttttacggtagctatgctgtatggattacagatgtagacccacggaatcatcgtattgaggttattcatgttatccgtgaaatctcaggaagaaccagtgaatatgtcaataacctactggctcaaccaaccccattcaaagtatttgattggctcacagagactcaggctaaagagtttgtaagacgtctgaataacactcagggtgttatctctgtctataacaaactggaagacggtattcctgctaaggttgccgtgaaagctacagagccaaccaataaagaaaagctggaagctgcatcaactaagctgaaagctatgggtgctgtcgctactgatgcttatgaatttcatactgacttgaatgaaaatgaagagactattgtagctgtagtgaatgataaggtggttcctgatgttcagaacctacaccgtcatatccgtcaatctgcaaatttgaaagactataaaggctttactaagtttcttgaacgtctgtctactgtaattgataaacgtcgtcactctgttgaagacctgatgaagtttatggaaaaaggtgacctgccaattgcagatgatggctccattgttatcttcaaacgtctggaaagcaaagacaatcctgaacatctcaaagacgtaatggatgatgtatttgttgattgccattctaagaagattgagcaatgcgttggtatgcgtgtaatggttaaagaaaaccttgtagaccagaaccgtcgtaaagactgttctcatggtctgcacgtagcttctctgcaatacattcgtaatttctcaggcaacgtaaccattattggtaaagttgctccagaggatgtatttgcagtaccagaatacgatgttactaagatgcgtgtatctgcttatcacatcattaccaagctacctgatgctattcgtgaccatgttaataatggcaatccaatctccaccattgagggcggtacggaaatcctgaacatggttctcagtggtaatcaccctgaaccttcccgtcaggtactggttggtggtcattatggaaccaatctgacttattcagaactcactcgtaattatctggatgatgatgaagacagcgttattccagatgaaccagtaattaagaaaactgccttgaatatggaagagagctttacggcaactaatcctaaagctgaaccagtgaaggcaacggatgttaaacctattaagaagactaagatggaaattcttaaagacctttggaaccagttcctgaaagcagagacttctaatgaagctattacactggctgatgaaatcattgctgctaagagcaaatgtaagaagtcatgggcttctttaggcttcagtggtgacatggttcagaaactgattgatgctcgtgctaataagcctaagccggaaaaagcagttaaacaggataaaactgttgcacctaagaaagctacagtcacccgtagccggaatgctgatgttattcgtagttatctgaatgacaagggtatgtctgattactgtaaagctcatgccattcacgatgtgaaacgtgctgctaagaaatcttatgctgcactggggctgactcctgaagaatgtagccaaattgataaactgaagcatcatctgaagtaagtaggttaactattcaagtagctccggttgaaatatactggagctatctttgaagaggatacatactatggccaaagtttatcgtgctaaccgtaaagcccatgatgacgatattattcgtatgaatgcagtcggtttatcattgggaaccattgctaaaacactaggtgttcacccaactacagttaccttacgattacgctctcttggtattgaaccagccgacacgcgtcgaacatttatggagaacgtactagcaccattacctactcacgtagctgattggttatcagaacaagtaggaccaaagtatgagattcgacaatacgttcgagacttattactggaagcctacaataatcgtcataatcataaggaaactgctcatgaacgattcctcaaaagatacgttggtacaaactcagaactggtttctgaaggcagtacccaacccaacgagtaaaaacattagtacccaaattggttgtcatctggaagaagtagttgagatgctggaagaattggctccaaattctgaagaagcatacgatacacttcataatgccattgcagctttaactgaattgtcagaattaatgaagtcctctgataaagaagtttatgcacctaacagcaatcgcttggctgttctggatgcactggcagaccagattgttacagcaactggcatcggtactttcttgggtatgaacgtacccggagcactcactgaagtaaaccgttctaattattcaaaatttgaagacggtgagcctgttttcaatgagaataagaaagtaatgaaaggtaaggattacactccgcctgatttaaccccattcatttaaaagagccgcccatatagggcggtttttgtatctggagaactcatgtataaaagtactactaagctgccactaaatcctggtcaagaggcagcggcagaaggtttcttcgactttctgctcgaccccaatgcttctgaacttcgtattagtggacctggtggtacaggcaagacatttacaatggctcatatgattgacgagattatgcctcgttattatgagacatgtagtctgatgggaatccctgctctctataacgaagttattatgactgctactactaataaggcagcagaagtattagcccgcgcaacaggacgtcctacgtctacctatcattcctttcaaggtctgacagtacgaaataacctgaagactggagaagcagacctgattccgtctaagtccttcagtatcaaaaagaataaggtcatttttattgatgaagcatcaatgattgaccgtaaactgaagaagtttattaacgaaggtactcaccaaagtaagattgtttacttaggtgataaatgccaattgttacctgtaaaggaaacttcttcccctgtctacaatgacagtagcattaaagagtttatgctgacccagcagatgcgtactgatgtccctgaactccatgcactgcatgaacagcttcgtggaaccattgaaggtaagcatggattcctgcctattaaagcagttccaggtattatcgactggattgaagatggtgatgaaatgaggaaagaagtcgaaggtcatttcatgactaagacggacactcgtattgttgcctataccaaccaacaggttgttaactataacaccttcattcgagccatgaatggattccatggagagttctgtattggtgaagagttagtaagtaactctgctattcagattggtgctggtgaccgccttagtattgaacaggaatgccagattgttgaccaggattctgctacccgtaagattctgattgattcctctggcatcgaattagaagtacgtgattgcaccctggatactggttatggtggtgtctttgaaggtatccctattccggtagatatggattatttcattcgtttgcaaaagtactatgcacaccaaaagaactgggaacgccacttctatttgaaagaaacattccctgaacttcgagcattacatgcttctactgtgcataagtctcaaggttctacctacgacaccatctttattgatgctactgatttatctacttgccgtcagcctgatgtagtagcacgtctgctttatgtagcagtatctcgtgctcgtcatcgtgttgtgttctatggctctttggcagagaaatttggtggtctggttcgctaaggagaacttatgcaactgggtgaaaaacaaatccgtgaaatgactaatagtagtgaactggttcaggaattattcttagccgagttacgtcggctagataaagtgctggatagtatcattacacgtaatggggaaacattcgctgtatacaactcaacaggattcctgtatttaggggagttctattcgagttctcgttcatcacaacaacctccttctggtcatcgtctggctctggctaatcacctactggatgatatgcgggagtatctggaacaagcaggtaaacttctgctagaagtccatatggtaaatcagatggtctttcgtctggttcagggttgtaagacttatcaagatgttcgtgatgcattgccggaatgcctcattgctatggataaacaagggcatctgaaatccttacagagaaccagaaaggcagcatttactctggataatgatgctatggctctccgtcagtatgagaaaatcctgccgattatcgaatactatgcgggaacccatcttatcttttgaggtctgtatgcgtcacattacattcaacaatgagggtatctaccctattgctatccttactacaacgttacgtaaggatgatattgtcaaagcatacatggaaccctgggatgtagataaagattcagtaatgattcttgaacttcatacagccccagggaaaaagaaaactcctgctaaagagatgcaggagtttattacccaagaattagtgccagcattcgaagcagcacaaactcagtatatcatctgtggtgattctgaatattacaaacagctaaccaaacaaggtaaagctgatgccaatattggctatgtaatggattgtgcttatgggaaccagaaagttatttacgttcccaattacagacaaatcttttatgacccggataaggtaaagactaagattgctttgtccatgcaggctctgattgattatgtctctggttcctatgttgaaccaggaactaagattatccactatgctgattatccattaactccagaagctatatctaagtggttagataagttactggagatgaatgttccattagcagtagatatagaaaccttcagtctgaagcattatgactgtggtataggcactattacattctgttggaacaagcatgaagggattgcattccctgtggattatgagccaattgagggggctaccgaagccccttatggtagacaggttcacaacatgcttgttcgctctatgctcagagacttttttattaagtatctgaacaggcagatgtatcacaatattgcctttgacgtatatgcactcatttaccagttatttatgacagaccttctggatacggaaggattgttgcatggcatgagtatcatgctaagaaactgggattgcactaagttaattacctatctggctactaattcttgtgctggtaataagctaagtcttaaagaccaagctcaggaatatgctggtaactatgctcaggaagaaatcaatgacattaccagaatcccattagcagagttgttggaatacaacttagtagatggattgtgtacctggtatgtctatgaaaagcattgggatactctggttaatgaccaacagttagatgtttatacaaacatctttaaacctgcatgtgaagatattattcaaatgcagttaactggtatgcctatcaatatgaagacagtattggaggtagaagaggcattaacccaagactataacaatgcgttaaaaacgattgctgacagtaaagtaatcaaagatttcacccgtcttcttaatgaagaatgggtagaaaaacagaaccagattctgaagaagaaacgagtaactttagctgatgctaaagagcagtttaatccaaactcaggtgttcaattacagaagctactttttgagttcctggagttacctgtgctgggtctgactgcaagtaaactacccgctacaggtagtggcatactcaagtctttgaagaaccatacccaagataccagtatcctggaaattcttgatgctctgattgattacaaagctgtagataaaattctgacagcattcatcccagcattaaaaaatgccagacaaggaccagatggttggcattatctctttggtaatctgaacttaggtgggactgtatcaggccgtctatccagtagtgaaccgaacctacagaacctaccttctggttccagatatgccaagatgattaaaaaatgctttgaggctcctcctggatggatattttgtgggctagactttgcttctctcgaagaccgtatatctgctttaacaaccaaagaccctaacaagctgaaggtgtacatgggtgtgactgtttatacagttactatagaaggagttgaccatcatatccgagatgatgatacaatcgtttatgatggtaaaacttataccggtgaggagttctatgacgcttttacccgtggccttctatgaacaacggtataagatttccgatgaaggtttcatcttaaatcttgcaaacaatcaacccctaaaaccgactctcaatcctaacggataccttaaggttgggttagctaatggtgatggtacacatcatcaagagctacttcatattctggtagctaaacacttcatccctaatccttatggctataaacaggtgaaccatagagatggtaataaactgcattgtcataaggataatctggaatggtgctctgctactcagaatgttgaacatgcacttaaaacaaggctacgtcctggttacatgtctgctgacgataaagagaaatatctctttgaggtgctggcaggcaagcaagttaaagacatcgcttttgaaataggtagacgtcctgaaactttgcataagatgcttagaactaccgctgaccgacttggtgttcgaaatgagtgggatgatgttatgaggagaaatagaaaagatgttactttacgacagcttgccaaaatcaactcatgacttcactggcaagaaaattgacaacgtagtcaaagccgggagttcatcaggttacgatgggcatagccttcgtgcatatgcttacttcggtgagatgatgcccgacattaaagatacggtagagtctgttaattctattcaggagaagtacaaagcataccgtcaggattctaaagcacctacctttgctcttacctatcagggtacgtacatcactttgatgaagaactgtggtttccctgaacagaaagctcgaatggttgaggaacgttatcacacactttataaggtaagtgatgactgggttcaggctaaactagaccaagctgcaaaagatggttatgtaaccgtagcatttggtttacgagtcagaacccccttacttcaacaagttattcgtggaaccagtaaaaccccttatgaagctgaagctgaaggacgtactgctggtaatgcattaggccaaagttggtgtcttctgaataaccgtgctggttctgagttcatgcgtaaggtgcggaatagtaagcatcgtcttgatattcgcccaagtacccatattcatgatgctcagtatttccttatccgtgatgatatggatgttgtgatatataccaatactcatttggtgaaagcagtacaatggcaagaccatcctgatattgctcatccagatgttcatttgggtggggaactctccttattctacccaacgtgggctaacgagattgagattccaaactacgctacgcccgaacaagtccatgaagcaatccaaaaggcatttaaatgaccaaacaaattgaagagaaaaagcatcactggttagtagcagctcaactgacttttgttattcctgataacaaagatggtcaggaaggtgctgttattgttcagaacactatgctgcttactgaagagaaacaggtaactttccgtgacctgggacgtgctcagtctgctctgtttcagaatctgaatgaccgttttggtcaagtagtagatgtacgggatattgtattcctgaacgttagctacctgggtcatatgagccagcctgacttccagcaaaatctggtaactaaagatactgctgcgaagaaagctaaactgaaagctgtggagtaatcatgtctgaaaaactgtcaggtggttttaataactactatctggttcaggtaaccaaccctcaacgtatggaacagcccccatatcaagccgagtgtgaggatattatccaagcactgaatatgacctttgatgaagggtgtctgttcaaggcattgtggcgtaatgctgctgctcgtttaggtaatggtaaaccaggtaacactgccgtttatgatgcagagaagatggttcattatgctaaccgcattcttattaaagaatccggtgggcagaaaaaagaagcagaagaaccaatctctgaagctctgaagaggggtgaagagattcatatgtctctgtctgaattattcaccttgttaactggtgaagcagcagaaggtgaagtaatgagccttgctggttggcatactcatgtacccaaccgtttgggtgttatgcctgttgctgttgcaatgagcaaagcagaacaagttgatgtagtacgtgccgatggaacgactattactcatgtatttcctcatgagattgactggtctgataagattgccccctttgctcgaatcactgcatggcgtttcagtaacccatctaaggtcgcttctaaatgaaaatcacgaacaatcatgacgtgtccttgccattagctgtctggcttttgcatgacgagtatgattacgtgaaggataaaaagtatctttctgtgactaccctgcttaagccaattaagcacattgtcatgaagcatcgtgtagacctttctgtagaaagtatggacatcatggatttggtgtccacttctatgggtacaggcttacatgattctattgagaaggcatggcataacggacaccacaatgcattacgcaagttagggtatcctgagcgtgtcgttcagaatgttgtcatcaaccctacccctgagcagattgcatcaaatccaaacttaattcctgtatggatagaacaacgagcaactaaaaagattgctggttggactattgggggcaagttcgacatcgttactgaaggtcttcttcaggatgtaaaatccacctccacttacacatgggtaaagggtgggcgtgatgaagaacatagacttcaggggtcaatgtatcgttggttacatgacgacaagattaccgaagatgtgattcgtattaactacatcttcactgactggatgaaagcattagctacatctcaagaaaactatccaaagcatcgtgtgctgcataaagacattccattgatgtcttatgaagcgactgaagaatggattaaagccaagctggctctcattgataagtactgggatgctcctgaaagcgagattccagaatgtactgatgaagagttatggcgttctgacccagtgtttaaatactttgctgacccagagaaagcaaaacaacctggtgctcgttctaccaaaaactttcctactctctttgaggcacggaagttcatggcagagaaaggcaaaggcactattcttcatgttcctggtgaacctaaacgatgcaactattgctcaatttttaacatctgcgaacaaagaaagagatatttcccatgattgacctgaccggagtctcacatcatccggcgattgaagaaatcgttgatgtgttatgtaacaagacgcaaaacactgatcgtggttttttccgtgtagaagtggcctatttccttgcgaaaatggcttcatgtatgggtgcaactatcatcactaaagaccgtggtgaaattccagtaaacatctatgcagtggctcttgctacttcaggcttcggtaaaggccattcggtcaacattgttgaagacggttttatggctggctttaagaaacggtttatggaagacaccatgcctgctttagcagaagaccgtctgtggaaaattgctaacgaacgttctgctcgtaatgctactgaccagaaggaagagtttgacaaggtggaagctgaatacagacgtacgggtgcttatccatttacgtttgactcaggtacacctcctgctgtgaaacagttacgtcataaactcttattagctggatgtggtgctattaacttacagattgatgagattggttcaaaccttctcgctaatgctgatgtattaactgtgttccttgagttgtatgaccaaggcaagattaaacagaaacttactaagaatactgctgaaagtattcgtagtgaggaagttgatggtaaaactccagctaaccttcttctgtttggtacaccgagcaaacttctcaatgggagccagactgaggaactcttctatgacttccttgatactggttattcccgtcgttgtctgtttgctgtaggtcaggcagataaacgtgcatatctgagccagagtgctgaagaaatctatcgtaatctgattaagcaggataacaatgctgttgtgaataagtgggctaaccactttcatagccttgcagatgcatccaagtttggttggaaaatgacagttgaagatgatgttggtattgcactaatcgactacaagattcagtgtgaaaagcaagcagcagctttagctgaccatgaagaaattcgtaaagcagaactggaacatcgctattttaaagcactgaaattggcaggtgcatttgcatttgttgataacagtatcatggtagagatggaacacctgaagcaagcaattcttctggtagaagagtctggtgttgcattccagactatcctcaatcgtgaaaaagcctacgttaaattagccaagtatattgcatctgttggtactgaggttactcatgcagatttgcttgaggctttgccattctataagagtgggaatgctgcacgtaatgagatgatgactttagctactgcatggggctataagcagcatatcatcattaagaagacatacaacgaaggtattgagttcttccgtggtgagacactgaaagagactgatactaacgaaatgattgtttcttatggtgagaactttgcttatgactatattgcagagaaagttccatttgaccagttacatgtactgacccagcaagcaggttatcactgggctaaccatcatttccgtcgagggcatcgtgctgaagagaatgctattgctggcttcaatatgattgtcattgatgtggatggtacgtgtagtttggacgtgtgccatgaattgatgaaagaataccgattcatgacctatacgaccaaacgccatactgatgaagaaaaccgtttccggttaattattccaatgaactatcagcttgaacttgatggtgctgagtataaagagttcatggataacgttatggcatggctcccatttaaaacggacgagtctgctaatcaacgagccaagaaatgggaatcatgtgctaagggtacgtattactacaatatggatgctcccctgctagacgtaagagatttcattcctagaaccagtaagaatgaggcattccagcaagggatgcagaaggttcaaaatctggataatctcgaacgttggtttgcccaacgaattgctacaggcaatcgtaataaccacatgattaagtatgctctggctctggtagatagtggtataggcttcaatgaagttaaacaacgtgtgcatgagttcaataagaaactcagcaatcccctatctgctgatgaactggattccactgtaatgattactgtggctaaacgttacacatcttaataaaaactattcagtccttttcttggttgaagaggactgtcagttaaaagaggaaactatgtcagaagaatttgaacatggcgaaatgaatgaccagctaatcctgattgtaggattttctgctgctggtaaatcagcctcacttcgtaacatccgtaaccaggaacgttgggtatatctgaatacagaagctggtaaacgtctgccatttaagaataacttcaatggtgttcgtattactgacccataccaaatcctggaatactttgaccaatgcattgaacatcgtgatgacgtggacggaatcattgtagattccctgactttcatgatggatatgctggaaactcagtatgtactcactgctgcaaacactcagaaggcttggggtgaatttgcacagttcttcaaaattctccttcaggagaaagtagttaaatttgccaaaccagttatcttcactgctcacgtcaaagacgaagtagatgaacgtgcaatggaactgaagactttcgttccagtaaaaggttctctgaagaacaatggtattgaagcatacttctctactgttgtatcagcagaacgtatcgaccttaaagaacttgaaaagtattccaatggaatgttggaaattactgaggatgagcaagagttggggtacaaacacgtattccagactcggcctactaagaaaacagtaggtaaacgtattcgttctcctatgggtatgttcagtaagcaagagacttatatggacaatgatgcccaaaaacttctcgaccatctggcagagtattactctaccggtgcttaatctggttgttagtcattcattaatttaattaagtaggaaatataaatgagcaatttattcggaaatctggcaggtcaggcagctaaagcagagaaagcaacggataacctgggtggtggatttggtgcaaaagaatctgacatttatctggctaccctgaaagtagcttatgcaggtaaagcagcttctggtgctaacttcattcagattattgcagacctgactgaccttgatgggcacagtgctggtgaataccgtgaacaactgtacatcacttctggtactgaaaaaggctgcaagtgtacttatgagaagaatggtaaggaatacttcctgccaggctacactgtaattaatgacatcctggtaatgacttctggtgagactattcctgaagcagtcttcgaagagaaagtcgttaacgtatatgacttcgatgagaagaaagaagttgccaaatctgtcatggttccagtcaatgctatcggtggtaagtttgctgtagctattctgaaatctgaagaagataagcagactaaagatggctccggtaactatgtgtctactggtgaaactcgtttcactaataccatcgaaaaagtattccatcctgacctgcatctgactgttgttgaagcagaagaactgactgaacgtggtaaagaactgaccgttgaagaagcagtcttctgggacaaatggttggagaaaaacaaaggcgttacccgtgataaaaccactaaaggtggtgcttccggtaaaactggtcagccaccaaaaccaggtgctactaacactggtgcgggtgcttctgctgcaaaatctctgttcggtaagaaataatgcagatacctgtgcttggagttgaccccagttttcgtaactggggactagcacggggaatgctcgacttagagacgggaatactctctggattagacctgaagctggtagaaaccaaacccgatggaaccaagcaagtaaggcagaacagcaaagatatgcaagctgctgaagacattactgctggtgtcatcgactggttcaaagaagcaaaggtcatctttgtagaggttcccgttggttcacaaagtgccaatggaatgaaatcctatggtgtttgtgtaggcatcttaggagcactcagggcattagggcatgagattattgaagttactcctatcgagaacaaagtagctctgtctggtattaagactgcttctaaagatgtgatgattagagcagctacaggattttatccagaagccaactggcttaaggataccaaaggtaggctgctcaataagaacgagcatttagctgatgctgtaggtgctatccatgcaggagtactcactcctgctttccagaatttaatgagaattttatcaaaggtataacaatgcaagtaatcctgacccaacctgaaatcgaagctgctctgactggttatgtaaacgacctgatgtctgtacgtgaaggtatggaaatcaaagtaaccttcaaagctacccgtggtgatgacggtgctactgcaatcgtagatattgtccctgccggttcccaatctgttgaagtggttgaggaaccaaagaaagagtcaaaggaacgcaagcatcgtccggtaacccagaccaatactgctgctgtcagtgctctggcttctgctactggtaagaaaaaagaagaagtagttgaagtagaaactactactgaaactgttgatgaaactgttgaagtagctgaagaagctgctgctcaggaagaagaaaaagaagtacaggaagaagaggctaaagaaccagtacaagccaaaccttctctgtttgcaggtctgaaacgttaatatctgggtaaacggtggctacaaagctactgctgggtgtggtggtgtttatagttttgattcttcttattgtcagaattatagacgtgtcggctccatatctagcattcattatcaccgtcattatcttgtataagtgctgtggtagtggtggtggtgacactaagccgccagatgtttaactaataagaggcgactggattactctccccagtcgcttcgttagtttattcatcgcttagtaaatatccaaataaagaaagaagttgtttcttgaaattagttactgcttgtaagagcagataagtttgtagtataactacgctcaaccaagatggtgtagctcagtggtagagcagttggctgttaaccaactggtcgatggttcgaatccatccaccatcgccaaatttggaaggttgtcagagaggccgattgtacctgacttgaaatcaggaggcgcagagatgcacccgaaggttcaaatccttcaccttccaccaaattgctggtttagctcagttggtagagcaattgccttgtaagcaatgggtcaatggttcaagtccattaaccagcaccaatacaggttattagtgaacacactatggaacctcccagcttcctccagatgtacggcaatacattagctggtagtgtgttcactgataggttgtactatcacagtccagacaatatctgcgtgacttaaaaaacagatggagccaggtggaatccctggcaattaattccggtgtaggtactagtgtcgtgcacggcatgagtgttctggttcgagtccagacgccggaaccaatttgaaagaactcttattttggttaccgcaaaagaagtgaaaaatgttgtggaaaactacttcccaattaggttcgaatcctaaaccagagtaagagttctttcgaattgaagatttacaggatatagctcagtttggtagagcgtctgctttgggagcagaatgtcgtaggttcgaatcctgctatcctgaccaaattagtgctctggtatattacttttaacccctaggttatgccacagtaatacaacagattgggtcatctgaaaccagagcactaacctaatgtgtgggatgtaacagttaaatccagttgccggaagtgcaattctagatacgctgccaatgtatgaacggtaaggctgtacaggactcggactcccatcccacctccttatttgaaccaggtatgaacggcttacttagtattaactgcataggggtatgttagggatacttaggtggtaagcagttggtaagaatccaacatggttcattccctattagcagtaacatagtcctgagtacgtgtgctctaaagacaatattggtgagacagtccaatagctgctaaattaaattcgtccattcctcttggatgtgtagcgagtgaaggtaacacttaaaaatccataacccacagaagcctccagttaatcctggaggcttttttatttaattaaataaggaatcaagatgaaccgtattactgaagaacatattgatagcatcattgaaggtgtttactacttcaatatggctaaagctgtagagaatgaggcagttctgattcctgaagcccatttaaaagcattgagcacaactactgtttgtgcactggttctttctaatggattcactattactggtaaatctgcctgtgttgaccccaacaccttcaatgaagagttaggtaagaaatatgcttacgaacaggccattgataaagtatgggaattggaaggctatctgcttaagcaaaacctgtatgagaaagctcagagccaggaaatgctgaaaggattcctgcaagatgacaactgtgaaggtgggggctgtaaaatctaatggaaattaaagttcactttactaattacatcggaaccaaatgtgtaaatggtttcccgatgaacaaaactgactactgcaaacttcgtggttgggatgtacctgctaatgaagacccgttagaagaaggttacttagtagagtatcccgattctaaacctaaccatgaacaattctgtggctacattagctggtcacctaaagctgcatttgaagaagcatactgtgatgtagacaaaggctgcacgtttggtcacgcagtagagcttatgaaatcaggttttagaatgtctcgtaaaggctggaatgggaaaggaatgtatatcaccttagtatccggtgaaaactgggctatggataaacatgaaaataccgtatgcatgaaacgggattggctgggtattaaaaccgctgacaatgagtttatgccctgggttccatctcaatcagatgtattagcagaagattgggtattagcttagtagaaattaaagcccctcattagaggggcattttttattagtgggtaaggttgaaccaaggattgagggtaggtgctcttagcccttgtccgaaacctaatgaataatccagtcttccttcagccagcatggttagcatgttgtcctgaattggcagacctacattaccaaacatggcaggagcaggtactactgtagcaatcagagaatgtactgggttgtttctaatcatgctcatagcaactttaatagaacgaattttaaagttgtagaaccacatcagacccatactttccatatagccacggaaacgaccaggcaatctgtcatagttaataaactcttcagttacctgacccaatgcttcagaagaagacttcttcttacgtttcactaaatcatcatagatgatggctttagcaatgaagtctgaatactctaccgttttctggataccctgaaacagagcagtgtccttagcaataagagcataacggccagcattacgtactttttctgggagtttattagcaagtttttccatgtattcatgaatcttaccttcagctactaacaggtcatcacgactaataccggcatcagcaatagaagagaactcacctgcttcaatcaaaggccagatactcatacgacgatgactatcagtaatagattgaatctcagttttaagtttacgaaccagattaggattaccttcagcagcacgtaattctgcttctgcatcaatctgacgtaagcgagatttaatgtactgattaatttctgacgtcttacgaggaatattcacagcaatatccttaacaggaacaccacgcccaatcatctggtagatgttagcaaggaagttaactgccggtactacaacagatttaacaacaattactgtcttagcatccttcaccaagttctgaatggtattttcagcattcattactacatgatatgccttattaccaaatgcaccgaggaacatcttcttaacagtatcaagggtgctaggtgaccaacgagagttaccagtccatacatcaccaatagatgcagcacgatagccaagtgcatcattcagcatatccctacgaacccataactcatccttaccaaagagttcttcagccttacgacgagtctcaatgttcatcaggttaattgcatcagccagtactgggtcatcaattttacctaacaggtttacatattgagatttattagcactggagtctttaatgtctttctcatacatagcatgtaattgctcaatgagaatgtcattaaaacgttgtgctttagcctcttccacctggcgaccacgccatacacccaccatcttagcaaaatgattgtcttggtttagatgcttcaacatattagggtcaacggattgctcataagcaactacctgacctttgctgttataaattggcatcagtggttcacgcccacgttcacctttagccagagctttggtaatacgctctacggttggtttgtcagtaatacgaccagcaaccatagtacctaacgtaaagccagtaccaatatccaccccaccagcagtattacgaacattctgaagaataccctgagagtaaggagcacgagcagctactgggctgaagtaataacctttagaaccagtacggaaaccagtgcttccctgataagtaccaatacgagtaaaggattggctatttaacttagcaaactctttatcgtcagcaataatcaaattcacaccttgctggttctctacagggatatagcccttaaagtgattcagcagagtacgattatcacctttagctttacgcatctcttcagtacgttgacccaccatataagcaatggagaactccataccttccacttctgattgagccagttctgacaaaaggtcacggtcagacttattcatcaattccagagagtacaaagtaatgagcttatcaatagcagctacatctgccacaggtccattagtaatacgttcacctaacaaacgactaatagcatgagcattacgaaggaggttattacctacttcccctgtaatcatgtattgagccagttgcttagatttcttctgaaccaggttccagtttctacctgcttggttctgaatctctttttccagggtagaaatttcatctttcactttcttggatgaagagagtaaatctctaatttcagccatgctcatagtttcacgtagaacagctaaatctgttttacctaaaccagtatgcattgcagaccactcggtatcagtcagtttacgagagaacttaccagcaatgactgtaggtaaatgctcacggaattgttgacggtcttgagaaatctggctcttaaccaatttgattaagtcatagacattggcattagtcttagtacggccaacaatgtcattaactaagtcatggaaaggttgccatactttaccctggttcatagcagtcataacaccctgagccactatttcaccttgtttttcagatgcaatagcagcagtcagtttagccagatgagcaacacctttagcagctatattagaagggttagcaattaccttatctgccttctcaataacagtttcagataaccgttcaatgctatccgttacatactgattagcccggtcaatgaagttaccggtaggggttgctacagcatcatagaaggactctcgtttcagagcagcagccatgattgtttctgacaaagcatcaatactgtcttgaacattagtagctttctggtcaccagccatacgacggttcagagattccattacctgagtacctgcattggtaagcagagtatctacatcattccctaatttcttatctgctttaggtacaggcatttctttaatgattgaacgtagttcttcattaaccatagccagacccaggaatgtaggtaacagactggttctgcctttagcatctacttcaaccagattagcaccagagatagtgtcatatttctgttgagcatagtaacggtcagcaggattagtactatcagggtcagccatgaaatgttctatcgtaaggtgtttcattacatgagtataaagttcctgagcacgagccatagcatgtgggtcaattgcagcttcagttgctaatgcagcagtaaccatctggaatacagattgttcctgagcagtcatattgaagccacgagactgaacatcacgaaccagtcgagtagcactcattaatgcattagccacattgccacgacgttctacttctgtaactgggtcagtacgaaggtaatcggttaccagtttatcgaaggtctggttcaactgagacagacgttcattgttaccatatgctttgctatggaacagtgtgccatctttagctactgcctgagttgtaggttggctacgcatcagaattgcagagttaaacagcaaattagagaacatatcttctcccaatgcaggagcttgtttacgtccccaaatcaacttcttaatagcctgataaacatctttcaccatttgaaccagtgaagatgttctcttctgtttagcagcaagagcacggttagctaatccccaagccataaactcattaagagcagcagctttagaaatagctgggtcaacaaagccattactcaaatgaccttcaatagttgcaatagcatcagcatatgcttctctcatttctggagaatctttggaaatatccagagaacggaactgttccatcaaaccttcaaggttctcaatagcctgcttagaagtggggcttacttcattaccctggtagaaggaataaacctcctcgaaggtagaagcatgaaccagttcatgaatgagggtttccatagatgggctaaccagataaatggtcttatcatcgaagttagtccagccataaatattacctgcctgagcttcttccatttcctgagaagtcaattcagtaacattcttctgacgagcatactctgcaacctgagtaggtgtaccgtagataatcttatagtctttagctgccagtgatttctgaatctctgcaagagtagctgcctgagtagatggcagattactaatcttagccagattacgaatagcagtagcagacaggatacgaacaccggatgccttatgctcacggcctaccataccaaagtctggattcactggttctttttcagaaacagtttcttctttgacttcagccttagccttagcgactttttgtttacgggcttctaactcttcacggaaaagtttattcagttcatcagcctgttgttcaggagtcatattgctgaggtcaatcttaccgttgttctgataaggagcacctacagcagccatctggtcaatggacagatttaccttatctagtaccttatgacgaatatctacacccagtgcaatattacgtaagttacgttcaatcagagatgcagcattagcaatatcatctacagtagcattctcacgttggtcatattccagagcagatttaccaattgcttccaatgcttcaggggacaacttgctgaaatctacattcttcatgaacttagcatatgattcgtaaacatttttaatagggttaccctgccaagaagtgtaaacagcttcattagccttacgactagcatcagtgatgtcattcaaaccaatgttcataccatcaaagattttgagggtattttttggtgcacctttcatagtggaaagagtttgcatcatcatgccatcaccagtaccaatagtcataaatggaatacctgctacaccggcctgtgctggggcatagatactcattggtacacgcatacggtcatcaaggttagtagctaatacctgatttgctacttctgcattttctgaaccagcaatgtagaaagtctgagaaccagtctcaatcataggggctaagttattcagagaagcctgaatatcattcagttctttctgagtaaggaaatcacctttcttccatgttgtgtctttagccttctctgccagcttctcctgtactcgctgtttgaacatatcttccagcactacagattgaatctgagtagctttctgtaattgttcagtggagtacaccagactttcacctacagtctgagtaataccattacgtagtggttctacgaagaagtgcagcatattttcctgaagtgccttcagttgctcacccttaatggtataggtcttaggattgattttccctttggctccagcacctgtggattgcagttccagtacacctttacgcttaacaggaacagtagaagtcagtgtttccatatctttcaggaaacgggcaagaagttcttcagcatgtgcttctgaagcagcttgcttaccaaacattgccatagcagcagagatgtttgggtctttagcacgagctttcagcacatcagacatacgctcatagatggcatcggtaacagaactaaccagcttacctgcaataccacgagcacctgaaccatagatggtaatagtcagggggttcttagcaataccacgtttaagttctaaagcaccattctcgccaagattaatatccggtaagaacaaatccatcagagaaagaagactgtctatctgggactgaataggcatattagacgcgtagttactacgtaacttacccaacgattccatcaaagcattagtggatgcttgatataaatcattattgtcagcagtagaacgatgctcattcatggtcttatttgaagaaccaatgaacaagccccctttggcaatgttacgaatccagtcaggagtaaacagaccgcctgtcattagcatcatggcattgattggaccattagtaacaccatctgcttctacatacagtggagttacaaatgcagatttatcctctgctactaagtaacgggaatactccataagagccattaatgctacgaatgacttcctatctcctaatgctgtattcagaacatcaactgcattttctggtaaggaaccagtggtattaaactcaaccatcatatcaatggctggtttcagattaccttccagtaatttagttaactcatctgacataacctcacgagtcatagtatggactttaatgtccaatgcctgagccagacctaactggaatgcagagaagtcttcattgttctggttcgataaatccaaagtagctttagtaggtagtatagcctcacgaaccagtttggctgattgaggattgtatttacctaacatctgcatacgaccaacacgggtcatattgtatgcatagtgaataggcacagtagagatgtcctcactctgtgctcttacctgctcaatgacggagaacagttggttgtaagaatcctctactgaacggttcttaccttccagagatttagcatggttatcattaagtaactctttattcagagtaccagcacccatcagttcgagaatacggtctttacctaacgtttcatagaattgaaccattggagtgtgtacatagaactctgtagcctgctctgctttcaatgcagccttctgttctggagtattacgaacagcagggttacgaagctgagtattagctacaggaggaatgtcatcaccaaagaacatcttctctgtaggattcactaaaacagcttcttcaatagcagtagggaagctattaattgggtcgaaggaatccagttcagtaatggtgtacagaccaatagtcttcttattatctgggtcaatttctgacatatccacgatgttctctacaacatccgtagactctacaaatgcagccagaatttcagcagccattgctgtagggatgcctttggtatagcccaatggagcatttggattacgagataatccccagtaagactcaattttctgagccagggaactaactgcttcggtgagtgtcataccagtatcaaattgctctactaaaccttctggcagcagagcttggtcaataccagtaatagcagcaacatcttttgcatctttgatagcagtattgctggtagcagtaagtctccactgaagacctgctaatacagcagtctgtagcaattgctcgttgtacttaaaggtatccccatcctgttcaacgatgttaagtaacttaccacctacccaacggttggcttctgtaccctgagcaaaacgtttaccaacatccttagtgttaaggaacttagccagacgggaacgaagaatatcagcaataccttccccatgttccatgagttctttgtatcgcttaataacttctccattaaaagcaggattagcaacatctttctcagtaaagagttcataacgagcacgggaagatagagcttgagctacatcttttagaggtgcttctgaaccaacagtacgggatttctgttcttccggtaaggtaaaggacaatttgaaatagttcttaataccctctgctttagaatcagcagtacccaccaatgaagggtaaacagcatcaataccttctcttaattcttctgtaactgtactttcttttgtagaagtttcagtttctttaacagattcagtaggttgcttgatgttgtcctcattagtaaggttaacatcctgtttttcagactggctcacaggttcttttatagcctgtggtctagactctttagtagtaggttctgttttaacaggttcactaacaggagtcttagtctgtacagtagatgtaactggttcctgttttgtaacaggagtttctttaacctgattcacggagtcagctttcggttgagaagaagcaacgtctcgattgccttgacggaatgccttgaccacctcagcagcaggagcgttaagacgtgaatccaatggagtaacttttatatgactgaccttcagttccgggtaagccgaagcgagggcattagcaatatccgctaccgttttcgcttcaagagcaacttgctgggcaaatttaaccgacttagtgtcatagggattgacccccaatccggtacggctacgaacccattctctgtcagcagtaagagcttggtagtggacagacttattcttatccgcattccccgtaacaagatgctcattcaacgctccaaccttattctgcatgtgctgggcgaactgcataaagtcgttcaggtaagcggaggccaactcgaaattaccagagttatacgcagaccgaatcctattcgcatgttgcaacgcagagtattgtccttcctgagttctgctctcatccgttttaatctgtttactcacaatgtcttgaggacgtaatccaagacgggcagcttctgcatcatattcccgtgcccccttcaggattgcagcagcattctgaagggcagcaatttggcgattattcagtttaatacgaccatcagcagcatgtttaagaacaacatttacagattctggattgagcttttcaggagctacttcagcagctaatgctacgttctgcatttcctgtggactggattcttcagtcacatccaaagaaccattctgggcagattcattaatcattcgattaatgacattcagtgcaccaattacttttggtgtgttctgaatattagctgtcagatttgtataacgattgagtaactcaatagccggagaatctttaggaatgctatccagtgcagcagggtcacggttaatgaattgctcaaactctgaaacagcatcatacatataagatgcagcttccatcagtgcttgaggattagattcatctaatgtgttaactaggtctgctaacttttgaataacctgtacttggtcagtagaaccagctacagcattacgaatatgctctggtgcttcctgataattttcaggattaaaacgagtagcattcattaagtcagaaacatactggtgtgctgcaactttctgttccggagtagcatcagttgcttcaacagcatcacgaatagtaacttctgcttctggtgcttgagccatagcttcttgtgctgcctgtgcaacatagtcatcagcaacaggagatgcttcttcattttgcttcataacccgctcaccacgagctaccaaagtgttcttaataggggaaacaaccttacctgctacactaccagcagctttaacaccagccattgtggtacgcaatataggagcagttgcagcacctgctaaacgagcagcaccagccggagcctgtacaacaccagcagaaccaaagccataaagagcacctaaaccagcttgtgtaccgacacctttaagcaggtcttggttcttatcaatgttttgttgctgtgcaatattctgagccagttggcctgtagcaccctgaacaccttcttccactgtttcacgggcaaggttcatacctacagcacctaaagaaccagcacggaaaggggccatctcaaaacgagataccagaggaccagttgcagcagcaataggtaattgaatagcagcagcagtaagaccagtttcagatgcagtctgacgacgagcctgttctggagacataccctctttaatatgttgctgataaacaggagacttctctaagtctttaagactcatcttcataatttcatcagcagtttgttggtatgcaccaccagcttccattgcaccaacaccaaccatacccggtgcagctctacctacagtagaggcaatacgagccagtgactgagtaccagtacctgcatcaatagcaccagccaatgcagcactacgaagagtatttgctggaacaactgctttacccagtaaagatgcaccccttaatacaggaccagcacctaatagagaacctaccccttctgctaacccatcggaaataatggagtcagtttgagcagcattctcaattgaacctacaaaatcacgtccaaatttagataaggaagctactatgtcattagtgccttctttcttatctgtttgatactgacgttcactctctacttcattcattaagttacgagcagcaaagagcttacgtttatcttgtaatgcctggctttgggtagcatgaacagcatcattaaacttactcaattgttgagcaacaacagcacctgcatcatcgttgagtaagcctgccccaagagcaccaatgcccccaagggtattaacaaaaccaagaccaacaccagtagcaatatcacccagttcttccccaggagttcttgtagtaactgaatcattgaatacctggttccctgcatcagcacgagcgttgataagttgtaagccttgctcaaccccatacttattcatgatttgcattggagtcagattcatgaaatctgattgcactgtccctggttcaaatgcattagccccaacattaccagtacgggcagcttgcatttgataagcagcatcaggagaaacaagaggagtagtgacaccttgttcagctttcttctgggcggttgcagtagagacgtcaacttgctttgcattggttacgctgtctgcgaacccagccagtctatcaaatactgacatagtaggtttcctatacaaacttatatctattagaaatcacactatacctagtgtaaggacgagaaaaaagccccgaagggcttttgtattatggtagaaattaacgaggaaatatatcagggatacccaatcgacgtccggcatctctgcctaaacttctccggtttgcctcgctttcttcctgtttaatattttgtaggctcttaatatccaaattctgagggtcagcagctacagcactacgagcaccatcaagaagacgtttagcagtattaactcgctcctgatagcgaggtagtacacttctaaggttttcctgaccggtctgaatacgacgctgtacttcacgtaaatcagcaagtgcagtatctaacgtattctgtgctgcatagatgtttgattgaatttgtgcagtaagctgattacgagcattctgttcaatagcagtaccagtagttgcaagttttgcatttgcctctacggcttctttatccagttggtaatcaccacccaaatcaataacatcagtatcaaaggcattccgaataccactaaaccatccctctggtttaccagtgatactacgttgaatgattgcccctgccatagcgggagaaatagcattctgttttgctacctcattgatttgtcgaaccagtgcaccttgattaatgcctttcagttcattgctatcaataatacgtttagccacctgaccagtcgtagaagggtcaacagtagcagcttggtattcaggcagcagagtattaccaatattctgcatattacgagtaccaacagtattaccagcaacagaagtgaatgcttgttcctgtaatggattaatagaattacctgtttctgcttgagcaatgtaatccttcatttcatcccatgacaagttcttataagcaccaggagtatcatccggtaaagcagcccatgtactcttcagattgccattcttacgagcattaaaaatagcttcacccagtttgtcttggttctccggagacataggaatgttctgccaatcttcaccaaatacctttggagcaaagtctttaagggtatcttggttaatctggtatgcaccaacaggagaagcacctagtgtcttcttcatagtgtcttgatgctgaaccacctcacctaagttcatctgagtaataggtacatcagttggtgtgaacttataggtagtgtcatatgcagaaccattccgagtaccctgagtaccaggaggggatagagatgcagaaccagttcccggagtatatgcacctgggtatgctctatctaactgagataatgcacgacttactgcccctggtgacatttggtcgaatgtaccctctgcaagcatacgagcatcgtcagcactatatgcaccacgacgaatattattcagtaactgcatagcagcctgagtatccgcatcgttacgcatatcaacacctaagttgaataagctacgacgttgaccgataccagcagtaccttgtccttgaaggttgttcatgtagtccataacaacaccagcaggaagggtttttaatatatccccatactgagcctgtgctgcctgaacctttcttgggtcaccagattgataagccagagccagttcctgcaatgcaggggcagcagcatcagtagctgcatttaccttcatggttctgtcattactgtatcgagtgaaatccagattttgttgtttagatgcttggtctaacagattgccagcacgattatctaagttctccatagtacgagaagaaattagagaagggtcatagccagcaaataatgctccagaagctaaggcattacgatactcattagggtcttggtaacgcatggcttcagccataattgcatcaccagcttgctgtcttgcagagtttcgaaaatcacctaatgcattacccaatccggcagtggcattacccagcatattggagaaagtacgaatactatccccaacaccagagaaagaaggagcatcaacattacgccatgtaatttgagccatgtaatacctcttaacgagttaagcgattggctgcaatgtaagcatcagccgtagattggtcacgattttctgcaacagcacgactacgagcacggtcttccagagcagtgttataggacttaatctggttattcagattagtgttagtaacatctttagcaaaagagaactgattcttagctaacttgttagcctgtaatgcaccataaatattacccagtgcattaagaccacctaaccccaactggaaggtaggaatgttcagacccagttggtcagtaagcccttgagtctgcccaccggtattccctgtagcaccaccagtaatattctgaagccagtcattactaaggatgccagattgcatagggttatagttcatggttggggtattaaaggaaccatacccatagccaaaattgctttgtgcagatggggttccaaaaaggaaattagtatccataaggattctcctgttacgtatctaaatcaagctgcaacgttatatctgcaaagttggtaatcatgttgttagacatgtcagctatatcatgaccagtcataagagtacggctaaggaatgaatccaatggttcaaattgttggcctacattagttaggttcattgggtcaatgtaacccatgccctcagtaccaaacatttcctcgtacttttcctgaatggttttcatctggtcacggtactctgccataagtttctctgtctttttgacagtttccatagcagaagcattgatgtaatcacttatgccattccctacagatgaagtgagtttaatgatgttgtctgctttcatcatttcacccagcatcgtagacatggatgaaccagtggataaagctgtaccaacattcatggctaccatagaggcaatagtagcaacaatgattccaatcttatccccaagcagactaacagagactgtttgaataatggacatcagaatcatagctgcaatggcattagccacagccccaacgataatagcagctaaccctgcaaaacctaatgcagcaccaatagaagcagcagtacccattaccccagcaccagcagcaggggtaaagaacacagacaccactactgcaacaacaaccactactactttaaagatgccagactgataccatttcttcttaactttcttatatgagttaagaaccagataacaacatgctgtagataactgagtaccatttaccaaagacatactacgataaatgttgttatgaagggggatgataaatccagactcttcatcatcatttagtgcatctacaccagaaatgcttacagatttattcttgtaaacattattgttatggttcaggccatagacagaaatcttcctccatgagttatccccatcctgccaatacattgttatcttatctagcctgtagatagtaaacccaactttgtcattacccttttcagagtacataacagctttctgcataaggactacagtaccttcataagcaaacttgagctgccctttcttggctccagagaatgcttttcccgaaccaactgactcttcaatgaagttccaactaatagtcatgttgtaacggtatccaccgttagaacgaatattaatggatttagaaggtattgttggatatacgggtcttttaggaggcttccctatgggaatatccctattaccactgcgagatttccaccattcctggtaagcatcaaagtccctgttagcctgagcaaagccttctaccaaagcatccatagttgggtagtttgggtcagcaggcattgactgattcactaactggaagaatctgtatatgtactctttagctgtattttcaggactattaagagaacaaccgaatacagcatagatatactgaatatcaccaatatctttgttcttcttcaggtcatccataatgtcagaaatcttaccccctgtagccttcttaaaagctctcttacaaagagtatacgtagagccagaaatccagttcttatcactacggatagggataaatgaatagaatctgttattggtcgtcttattaataaacagagcatcaaggatggcattaccactgttctgtttataaataaacaattgaggcataccaccagcagacatagtagtaactacatctgtattctggtaagaccatgtataacctaaagtatcagtagttactgtagtagttctggtttcagtaaccccaccacctaaatcaataacttcggtgtttgtagtggaaccagtggatacagtgccagtctgtacctgggtcattgtagtcttacgaataatgattaagcctacttcacttggttcacgaaattctttctcgtaaacatctgagaagttagtccaactaacctgttcttcttcagtattggtactttcctcatcaggtctaccatcagagaatacactcttaatatgagtaactgtcttcagggtagctgacttaggagtatggttctgagatacctgagtccattcagaagtagaaggtaagtcatcagcagatgatacaaatacagcagggtgaaccactgggtctgcaacactagtaggctgtatgtagtaatagttcacatacaggtacattgcatcctgactgaaattctctggataaaaagataactcactaccatcagtagcagtaagtacaatcctgtcatcatccatgatgtctatttcaaactcttcagtaatacggtctggatagttctcatagaggaatttatcagcccattcctcaaaatcaccgaatccaatcctactgctctgaacctgtacctcataacctgctttttgaggaacctgccatttaactacttcagggtctacctgagacagtattgacaagttcccataagcaataccaattgaagggtcatagttagttgcagcccaaccagggaatctacgtaaacgaataccaggtccatttaaataagagtcagtgatggtatcacccatactaaagtcggatttactgacgatgttaccaatcactgtagtctttaaataatttggacgtttatgtatatcccctgccaaattgtagacagaggatgctacgtagattttagtcttactgctaaacagtcccatgtattaccccaatgcgttgttattcttcaatgcagtaagaatgctatccagactggagttagtgaagccattaggaggagacagaccctcatcaatggttttctgagtgacccatgcatcagtaaacagtttggcagctttaacttcagcatcacgtttataagacgtaatctgttggtcatagagttctttctgtttacctacagaaccagctacacgagtaccatcagtacgagtatcagaagtctgggcacgttgtgcttccttctgctctttcgtcatattgatttgttcagtagttaacttagtctgttcagcaacctgagtagtctggttcttcaacatcagtaattgttgaggaagcatagaggacagattgtattgagcagtacagtaagttactgactcattagacagcttcagtttagtaagagcatattcagctttagtagccagagcctgaatcttagctgtaacaaagttagctttgataataccaagattagcacgagcagtaattgcagctacctgagcagtaacagcattccaataagcctggtctttagtggtaaggaattgcacagcattagccatacatgcttccatagtagcaatgtatgccttaacgtaatcaccacctgtgattcggttattcttaaattctgccagtagatgattgcttgctgattgcattaaagcatcaaatacacctgaaccaccaacctcacgagtagttagttgttctgtggttatcttctctatctctgcatagatagggctattaatgccaccaggaatatcatactcactgccagacatgtcgatgtcaggaagcgtaaaatcctcacctgctacaagagcagtaagtagagcattagcttcgagttcagcaccacatgacatggtatttcctcattggttcattaaaagaaaacggctcacggttttacccagtgagccgtgctgacttacagattaactcttattgagagtctacgctaccagcagcaatctgagcagcagccagagtttgtaattcttccttagtcagtggaggcagaacttcaatggcaaactcacgtacccatgcagacgtaatattaggctgaccattcttacctttggtgactcgaatgttcaggaacttacgttctttgaggaagttataaatacagtaagggatgtgatagccctcatcagtagcttcaccaaatggaacgaatttacggacagtaccaatatattcgttagctactgtaataatctcaccaggcaggtctttcttcttagggtcaaggttctgaatacgtactcgaaccagctttaattgttctaagcgttgctggtgacgtaaagaagttgccgtagttactgtacctgtagacagagccagaggattaggctgaggttctactggttcctgagctttattttcctgtgctgcttcaatcttcttacgaagagtttcagcactaatattatttgagtatgaaatacccatcatattagctcgttgtttcagcagagaaagttcatcaaccttaacttcatcaacggtgtcatcgttgccctgagttaaatcagcggtcggtttatcgttaatgctcatgtgtatatatcctattcataaagtaaggggaggtttccctccccctgatgttagcccaactattatagcggagctacagttttaataagagccagacgttctgggcgtttaaccagaataccgtagtaccatttgatgctggagaagccagtttcaccatatgggtcattacggtcagcagtttctttaccaggcatcttagtcataacggtaaatttaagtgacttaccgtcagtctggaagccaatggaggtaaaggaatcatcacctactaccagcattgggtaaacgtcatagtgctcttgaccagataccatagaggtacggtaaccagggttagctccagtagcctgtgcaccagcacctgcccagtgcagcatttctggaacctgaatgatacggaacttatcaatagaaccgacttcaccattcatgatagtacctgcatcagcatagtgctgagtttcgataaaggctttattaccgaacaggtctttcattgctttcagttccggaaccagttcagaacctacatacataacacgagtagcaccgatgactttagtatcaatcatacgggaaccagtgatgatagtggtctgagtaggagtacggttctctgtcagaatctggtcaagacgcatcaggttcttataagaaacgatagacggagtagaaccttcaccagtgatggtggcatcagaagtagcagcaccagcatacagaacagtaccagcagcagccagcaggtctttttgcagtacagcttcagtaatctgagtagcaccattcatcagttcacgggacaggtgttccatcaggccatcatcagaatcgaagtcaatagattcctgagtgaactcatagaagaagccaaacttgtgaatagaaccttcacgagcaatacgagtaaaaccaacacggttaactcgaccaccgttttcagtcagtagaggcagtttggaagtaatgttaccgatgtctttgctggaaccatacaggttaccattaacgatagtagcaccacttgcatcaataccctggtcattgatgttacggtcatccagcagaggaacatattcatataccttgatggtcttaccgtaatgcttcggcatgttagttacagaggccagtggcatgaagtactgctctttacgggcagtgatgattgctttcttcagccagaagaaggtttgcatctggtcagagttagcaccatcaatactagatttctgaccgtcaataggagcgttatagttcaacatgtctcaattccttataggccgttcagccgaggtagtttcataaagtcctcgtcactcattgcaagaggattaacaaggacttctgtcttacgcggtgtaacccgtgatggggatgccgctgctgcctgttgagtattagtgatttcagacttaggagttgcaacacgagttgctactggctgaaccactggtttaggttgttcaacaggtttctgcttaatcaaatcattaaaaccaccattagcagcaaggtagttaccaacttgattataggcatccaggaatgctgtaccgattgggatttggcctaagattttgagtcgttcaatttcagaaacaatacggtcgtaaataccgttagctttctgttcaacgatggtattaaccagaccacggttttccagcaatgcctgtttgctgtggtcatcccacgtagtcgaaattaactgaagagtagcttgtccttctggagtggatttagcatcttccagttcggttgcaaatgctgcttcagcatctgacacacggtgattaccagcttggtatttaacttcctcttctggattaatatccagaacatcaataccagattctttaatcaacttcttaatagcatcaggattccctttaactaaatcgatagcataagagagttgcccttcatctaataatccgttgttttctaacatcaggagatacttacgatacggctgaatctcctgcattttacgggtatagttagctcccatttgcatcaggctaatgacctcttcaggactctgaggagtaatcattttgccgttagctttaaacggagccattatccgttcataaccagccttatagtcgaagtcagttttctggtctgatacctgcttgtcttcttctacttttgcttggccttgctcagtagtagaaggtgcattatcagtagcaggcttactgttgctgtcaaccttatttgggtcaactgtagcactatcattaccagttgtgaatgcatctgaattgctttctgattcagaagtattttctacttcagttggttcagtagttacttctggttcatcagtttgttcaacttcaacaattgggtctggttgtgcaggagtattattttctaccggttccgggttgttctgaatgcttgatggaccaggcatgttcagaatctcttcatccgacattttaaaaatgtcggaagctgtttttgcagcttccgtagtcatgggagtatctccgagttaggattaattaaacttcttcaggttcaccacgagcaacatccaatgcattctcaatatctgattggacacctaccagtgtttctgctttctgaagagtaatttccagataacgttttaaacaaccagcagcttgagccatagcaagagcatcagcacgttgacggtcttcaagcaatgggtcacaggattcttgtacataacgagcacagtctacagtacagaattgctcaagaattactttacggaaaagggaattacccatcagcttacgaacatcttctgcataagcacgagcagctttaatacccttcagttggtgttccagtccttcaatttctttttctttgctatacataattaattacctaatctaattcctgggttaagagctgggtcacgggttgggtcaaactgactggaaccaagtgaataagcagggttggcttcagcagctatatcccgttcagatacagattgaatacctgtatcctccccattagtcaatgcattatacccaattgcagcagataagttagggggaagttctccttccttacgtggcttggttaatgctttagtaatttctaattgctgattaccttgtgattgagctttcatcttctcaaggtcacgagcatgtttagtgccagattcttgttccagataatccagattcttattgtctcgttctgccatagctttttgagcttgtgcatcattaagacgaattttagaacgtaactcttcattctcaagctgtgctttctcaacagccaattgtttgagttgttcctgtactgggtctggttgaggttgccatgtacgtaaatcatgagccagtttaggcatacgtttcaagtcagcaatctctgcaagaatattcaaagtgatttgctggtctacgtttggaccaatagtctgaagcataaagcctaagtcttgggacttttggttgtctacttcagcagtagaaatatctacttcaaggtcaaagttacctttcaggtcttcacgtttaatagtgacaaattcttcattggtaatacgcactacttcatgctctgccaaaaacacagcattcatagcaataatcttattaccaatttcagacatgcctttagctaaacgacgaaggatagccatctcacgtttagaagcagcatccaatacaccacgaataccggcagctacatcaccataagactcaccagttaccccaccagcaaatgctttaacaccagtaagagattctgcttcctggttctgaagggtagccatagtcagtgctgattgtggcaattcagggaacttatgctcaataatcatttgagcagggttttgtgtaggattgtattcataatcctcaccttccctgtaacgacgactattcagggcatcaagcatacctttaggcataccacgttgaccattggcactacgtccaagtaagtcaatcatcccacgcattacagcaccaagtactgcttggttatcacctaataactctgcatctggttcgccatacatatcccgtttaacaggcatatatggaattaatacaaatgggagtttgccgtcaggataaggattcttctctaaacgaataagagtagaaccaatccaagtagcaacaataggctctaatacaccattcccttcaatatcccagaatccccaatattcataagcaactacacgcttacgcatagggtcactaatctgaaattcttgaggagtagtagttgcatggtctggctcattaacaggagcagagctttgccaatcaatcttatttagattgtggtaacggtctttctctttaagcaggtctgccttacaagtttcaaaagagacaatggcaaacattgccttattaatatcaccctgacatgaggggtcgataataatgttctctgggtttagcatttccaccgtaggatggtttgctaaaggaacttcaacttcagttgtagttgtcccagtttgtactgcatacgttgcttgccctgtttcatcaaagaaacgtactgattccttaatagcttcatccacattctcttcatacccacgagggttgtctgtacgaagttgtagagcttgttgtaaagcatcagcttgttcttgtgtttgaatagggaacaaactaaatacaggaacttcttgcttctctttacgaatttccctgttccaaccaacacgaacaataccagtaccatcatcaacaactgaacgaacatagttatcaatgaaacttacacgattcagtttggtacggaattggtagttaagaaccagttcattctggcgtgcaccttgtacatcttcccaagttacaggagtaactttgaataacttattagaaccaaggaaaggttcagttaaagcagaataacgccattcagcttgacgacgtacaagtttaggctgtacctgtgaacgtcctttgactttaggtggcttggctttgccttcaatacgcataaggtcattccattctttgaccttaatcatcatggcagtatgagatggctttgctgcatccaagtctgctttaagtgcttgtaaggaaggttcattcttccagctagttagcttagtagcttggcttgggtctggcaatggaaccatagaatcagtgttttgttccatagtaattcctattcaaacagtttacggtcagaacgaatctggttccccagttcaatcagttggttatcacggagtctaacagttgccctgagttcttcaaccaaacgtctgccttcttcaagacttgagtcgagtctggctgcatggcttgcaagattgaggcattgagtggttccggttgaggcttgacgtttataactctcggctcgtttttctgactggagcaaccgactattgtactggttagtaatagaatcaataacgacttcataagactctttggctttatcaagtcgaagggtaagttgcccgacttcataactgtgttcccgattcttttggtcataagccagttttactctatcaagttcttttgagtactccttcttatcttcatcccatagtgcttgaactttcttttcaccatgttgtgaaccaagaagaaaaagggtagctcccagagctacccctcccaaaagacatacagttaacttaattaacgatgtcttcattacacctctccagagggacattaccaatacgattagcaatccatcctgtagtgtactcaggcatattaagagataaatagtagtttaactgtttaccatccagagacttcaaaatgagcttacaggcttctactttgcctcgtttattctgaaggctcttatatgcacttagagttccagaaccgactttaccatcaacttgtattttagggtagtctttgccatttctggaaaaagcattaagagattcttgtaaccaacgggatggtcttgcaggtccagtattaacaccagcatctactagtttttctgttaccgctggtgatacatctgcaaacttaacaaagccaggcttcaagatgtaatcgttgtaataaatacttgatgccatttcctgagttaagttcttcattgaaccatcccagttatacaccgactctagttcttgcttatgcttttgagcaacctgaatagttacaccatgattagtttcacctcctgggtctttggggtcattaacgtatccaccctcaacagcaaatacagcagcaatgattgctgcaataacccccccaacaccaccaaccttcttcttacttattgccacatcaatcctcctttggtttcaaacgaaccagtcggcaaataatattcagcacaaagagtgctatagcaatgttattgccatgtggaatatctttgaggatatgttggggtaatgcagagaaagaactggataagacatccacacaagagaagaacaatattgctaatgtgctaatctgaatagatgcccatttccaacaacgtttccaattaggaaccatttctacatgtttggttaacttgcgaaccatgcaaaaatctcccgtctggcagcagccagtataccaataatgatacctgctccagcccatacccatttaccaaacaatccagcaccaacaactttatgtttaatggtaatgaactcttcaatagtaggggcagactcagccagagacttttctacattctctagtcgagtgtccatcttattaatagacagttgaaggttacgtacagcatcatctaaatcttgccgagatttagcatcacgggcattattttcgaagagtgtcttcatacgttcctccattcgagctaggagcacctctacggattcatgactcatgctaaatccttattgaaaaagccaggtatccccggctctgttagtcctaatgaacagagagtgtgtttatacacccgtcaaatagtaccgatatttactagtatcatccacatactttaggtacggcataaattacaccatccctcattacttgcgtgtatgaccacgggtagatatgtgggatacccgcctctagtgccaatccccaagccttatcaacatcagcccagattttcttagcatcttcaggtaacagtacgaatcctatgaagtaatgaactacattcaatggataccctagtctattcacagcagcatcaaatgtcagtggaaccaggtcaagtcttccatcgataatccagtcatagtcttcaatctgaacaaagtcatagttaggaaatatccattctgactcagggaagtttaatcgacctgttagttcagatgcaggggacataatctgtggtgtaaagaacagaagagttgcctgtgcatcagggaacttaccttttacatagtcacgtatatagttagtggattgacccagtttggtacatagccaatctacataaggccattgatgttcttctactggagcaaagatgtctttaatccatggagtaggtacatcattacctgtctcttctttgtataaagccatagtcttagggtcataaatacaaggagcattcttaccttcacctgtattgtatgaaccatcccaccaccaaggctcaccaatctggaagtacagctccattcccaagttctgacattctttcaaaatctgacattgagctttacttacaaaatccagagcatctttgttagtaggctgaataaaactagatggtggataccaaccggaaagtgctgggtcacccttccagttaagctgtttccactcgtcaggcataaagaagttaagaatttcataagcaacagagttaacaaacttcatatcccgttcatgtaataaagacaggaatcgtttataaaactccatagtaggcatgttaataggctctggttcagacactgggtctaatcccaaacgcccaacaaaccaataatcatcatgctgtttcttaacaggacttactaatgggtaaacaggaaccagtctgagaacagacttagcaaggtctaaacaaacctttctggaagtctcaacattgaaatgaatctgtcctattcctggttcgaaggtaaagtcatccggcatgtactgtgccgtcaatgctcccatatgaacatcagtcatctcattaataagttgtgattgaatctccctaatctgctcccgtgggacagttgtaggggaataaggaatcggtactactgctgcattactcataatttaatacccccattgctgggggttccttgttaaagagtggctgtcatatcaaattgtttagctacgttagatgccccatctgcacgataaggtcttactctccaaaccatatggtcagtcaggtaaccgtactcggctgtaatttcttcagccgtccaagtgattgtaggtgctacaacaatctctgttttaacaacagtagagttctcagcattaagaatctcaacctgccattggacagcatcacctacttcccatgacatagtacagttacctacagagtctttcttagcaaagccctgtccaactgttcctgctgtttccggtacagcaacatactcagtagtaagacccaatgcacctgattcaatatcatgttcttgagcacgaacagatatgcttgaagcagtaaagccataagcagctacctgttcttctcgtgtgaacacaagattgttatcagatacaaactggtcactaatagttgcattggacgttacatgcatatttcgaatacgaacatcacgtccaccaacagaaggtttattccacataatcttaatattagagttacctgggtcaccggtgaacactgcatacaatccagcaacaggattcattggattagacggctgctctgcttgaccagtaacttgagcaccaatagatactaatccgttacttgggtcatactcagataccatgaagatgacatgagtagcaccaccttcttccaggccgtagaactcgttctgttctgcaacagtccatgttagagattcactagaccattctttagaaaagataacagtcttagaatcattaacactggtattcactatccagaagtgttgccatgaaggacgccctacccaagtgaagataatgtcaccattaagctgtttagcagctttcagttgagtaggagtctgcatataggaaccattctggactacccctacaaaggaagaagatgcacctactgcaccagaatcagcagcatattcagaaacagagaaactcatattaagagtgtccccattataagcattttgctggtcattcagggtaaacacatactcaggactggtgaggataccagaagagatttctgcccctgtggtgacatgacggttagcatacttccagtgggtaatcccagtacggttatcccatgtcatcttaatatcacgagtagccaacttacgaccttgcagatttgctggtgggcgtaagtaagaccaatcaggtggattagtagcacggttaatattaagagccagtgcttcacctaactcaatggctgtggcatggaatgcttctaccgtgtaataaatccaactggattccacattacggtacgcagtgtacaggttagaaccaggaacaaaggaacccagtttaaagcctatattagctgtagccatctgaatctgtttatcacgtacagtaacagtagcttgagagttaaggtcattaggaggagcaacaccaaaccaaacagtagtagccccttggaaccaaatctccagattagggttaccccagttggttctcatccatgcaagcattgctttgttagacgattcaaaagcagtcattaaagcaggccatgtagaagaattaacatccttcatatacatggtttcccacggattagcttcaatgaagtaatcaggtttaacacccaaacctttaaccatatcgttaatagccagtagtgcatcacctggggaattactggaagtattccaccatttgtgagtacctactgtcatacctgcactatcagcagctacgttaataggcattacctgaataggacgtaatccagctttctctgcaaaagtcagacgtagcgtagaagcagatactttgtctttacggccaattgcaccattagctgtggtagcagttgggtcagacatatcagtaaagtgtccaccaccaaactggttaatacctaccagaatggtcttcttaacaagccctgcattatccaaaggaatgttatctgaccaaggtgctgaaggaatttccttttcctggtacagacaaactactctccacttcatgaactcccacggattaggagaaccaaccgcttccatcattacaggaatccagtcttctacagtgaagtcagcatatacataaccatttgcttcttgagtacctgatactacaaatgagtgaagtatctggttcaaattagaagggttatagatttcaatacgatactgagctaatgcagggtctaatccgtaagacttccaacggaactcaatatctccccatgtattacgacgggctgccaggaaagaaggtaaccctgtacgaataggtacattaggttcatcagtgttagtgatgccccatgcataactcaattcctgaatgaaaataggaatctgtccatacaaactacgaagatactcaaataccttcttagtagcttgcttggttctggttaatgatggtgctgggtcacggtcacctggatatgccaaagcagtggcatcttggtcaccttgcccccaaataatagctttaggcttgagcttacctacttgctctacacaatatagtaatgcaggaccgggtttatctgcttctaaatcccaccaccaaagaccacctgcaccggatgattgggtagggtcaaatacttcagaatcaggattaactgcacatgcacggtctacagcagtagaaccagttgtcccattaatagggcgtacacctgcatagttaatgccccaagtttcagtcatgtacttctggaatacatcatagccacgatcagggtatgcaccaaacatgaagtgaatagcaacctgagattcaccagcaaatagaattgggtaatctaatacagtctgttctgtgattaactcacccgtttctttatcctgaaatgcagtaagacccttccagtagtgggacatgccaatataagtagtccaccagtcacggtatcctaagccataggccatctttacctgacgctcaggagtaaggttatagccatcatcaaagcctgaagtcatgcccatacccatcactacttgtggatatttacgttgacccagttgcttacgaccggaaccagatacagtaaggttagtaaaccatttaacagagtctacttgtttaataggaccatctgtctgtaagtatttaccatagaatgcatcacatcctatgaacttacctgggagcatacctttgcatttaacagagaagttagaagtaccaaagccttcataacttactacttcgaactcattctctgctgcttgagcattaccattaacatccaagtatctccagatgcattggagtttatccccagcagctaaagcagcattagtatgaatacccccaatttccatctggaaagtagcaccatcgtcattgttatacatggcggcaatgtaagcatctttccctaggccatgatgtgcttcagtacagtcgaaagaaatcattgtgatattacgagggttaatagttaccccattaaatgccacacctgtacgtaaatcagcaaagtccagaatgaagatatagtccttagtgccatagacttctgtcatttcagattcaggaatatcttcatcagtagctacaaagatgtcagcctgatacgttctcttggttccatactttgtatccaaacactcccatcgacgggttttattattgaatccatatggagccagacgatacgtatatgctttttcaggagtctgaatagtaactgtgaatttatctggttcatcggggttatgacgaaaagccagaatcagacctaagtaattagggtctgtttcataacgatacaggtgatggtcaaaggtatcctccgtcatccaacggacacctaagaagtctttgttagtacgccactgacaaggaactttgaaagacttagaaccatacggaatgatggtggctaccattaaggcattgtaatcaactacccaatactcagggtcgaaacgatttagtttagtgttataagttcgattacgacgagtgttgaccaacgtcagatgttccctgtctttcttaaattgagggaggtcttctctccaagaagagtgctggtcatccgggtcataattaggagaagctaggcaattcttgcctttgaggtaatcttcaatggacataactgctccagtaataaggccggtttcccggcctagtttctttaagcgttggagttaataccaacaacggaaataccttccgtggtgttaaattcactgaatttaacctgaacacgaccgacatctacgattagagaaccataaggtactttatagattccgtgcataccacgagagtacatgatacccataccttccaatggggcatcaagtaaagaaccatctggtttagcaatcttcaatacgaaggaactatcagtatgactcttcagttgtgctgtaagctgagtaccatcggtaggtaacagtaagctaaatgtaacagtagaatctttgataagagtactgtgatataccgttaactcaccagatgctgtatcgaatgcacaataagtacccgaatcccaatcagatacagcagcccagccaccacctgaatatttcagttgtgcttctgcttcaccaaccataaccagtacagcagcccctgccgtaacactggagaatcgtggggtcagtggagccttgcctgtaggggtaatgaaagtcatcactggttctacagtctgaagactaggtggatacccaagagtgataccaccatatgcatctacattcagagtcactgcactggaaggcatgatacgagtattcacaccggagattgctttagcagttaggtctgctttaaaacggagtggggcagtaacagatacagtagctgtattgttagtagtagatgcacccataatcaggccatccaatgccatttgttgactaggtgctaccaacaagccactaactttaccggctttataattaagaaccaggttagctactgcaccagcagtaggggcattcatgttgatggaaccagtagctaacgaccatactccacgagcagaagtcagtttaccagctatagcataaccacctttgtcattacccatagtaatgacctgacgaagcattgcacctactgtattagctgcgtaagtctgtgcctgattaaagccaatcagacctgcaccctcagcagtagcatacttttcatggtcagcaatgattgtatcaagctgttctgcaatggtaactaagtcacctaacctggcatgtacagccagtagttcagtcatgtgattatccaaatcaagcaatgctgccatattggtattcacattcttaatcgtattgatattagtacttactgtattaacagcatcaatggaaccagcaacggtattcacattggtaatgctattagcaacagtaattactttatcaatttgagcagaaacaataattaccttagcaatatcagttgctactgtattaactgcgtcaatattagaagctacagtattgattggggtcaggttgtcatagaccctcagcaatgcctgaagattgtcatatagaccagtcagtttagataattgattgtagagttcctgtaacttatctaaattattatggataagttgtagttcatctagcttagtgtagatagcagatagctcagttaacttgttatggatagcaagtagctgagtcatattatcactgacatttttaataaaggtcattcgtaatgctacgaacttaacaacgtagtaagcgttaccaatcatcttatcaacgattgggtcattaagtgtttcgcagcaataaccttcgttggggatagtattaaacggggtatgaccactcatcgccagcctctctttctgaacaaggtatttgtatcaacttctgtatcactagtgaggtcatattcaacaacctccctacagatgctgtcataaaaggacagatactctgctgcctttgctgaactctctggggtattcagagaagtgtaataacggtaagcaatgtaggcatccaaagctgggtcaagggtatcaggaatgtctatctcattatagccatcctctgctgtagacagtttaggatgtttagcctgatacattacgttcaatacttcccatgcttttggagcattgttctgtagaacgtttggccttggggtgaacaaactgtgaggattatttcggtcattcaacggacgtctacgacctttatcgtcatacacttccagaatacgaataacatcctcagcaaacttctcacctgctaagtccataatgaagggacacttcacttcatttgggtcataagactgaacagcatacttagctagtaatgggtagttggttctaccttcttgcatctcaacaaccacgttgttgttacgcatgttgaagcgaccatgcagacgagtcagtgcctcattagcagctacgataatgaaaggcttactatcatcttcaatgtcacctttgtcatctgtaacgatacctgtattgttcagcacaccattagccagacgacagaataactcttctatatagtacataagtcctcacacgatatatgaagagagtgggttaacacttccagtatcatcaccatcatcccacaatgggtcacctgatgtattaactggaaccatacctgcttgcggtttccacgggttcaggtagccaagcattgaaatggtatcaatacagtcatccttacctttaagaccattgatagtggctaaacgaatttgccccataaagagtgtcatgattgggctatctttcatttcagcaggaaaatacatcttaccagctttgaaccagggaaccacgaggttaaaccttgatagcttactggttacaggatgaatacccggttggcctccacgactggatgcaaagttaaagaacacattacggttaagcatttccttctgaagaagagaaataaaaccaccttgctgtccagtagtttctacaccaacttgttgtggttggtattcctgaaccagacggaataagtcatcaaagttcttatccatagtttgacggcaagcaatgccatctacccagaaccagtcaccgttagaaccatatgcccatactgatattacagagtagtcagatacctgcttctcgctggtagcaaagtcagtggtgatatagaagttataacaagaacggagacgtaatagctgcgtacgggaataccatttaatctctgaatcctgaatcagacgttcatcttcagaactgatacgtaacatcaattcctgataaaaggatgccagcttacctgtcttcaatgccatctggtattggtcattgatgtagtcataggagaaacggtcttcccaagcaccttgaaattcttctcgcgtacatgggaatttctcacatacaggccatacgttgacatcccaagcaccagattcaactgcttcaataagaatatcttccttattaaagggagtaccattaaagattaccttacgtcttgttgggtcaagagcatggttcacacccttatataccgtgtctttaatggcttccattgatgtacgtgagcgagcatcatcatcactaactaagtcatccagtacgcaaagaacgggacgtttaccaaaaatcttagtaccacgaagacctgtcttagcaccaaacatcttcacaccaagacggtgaccttcagcatttacaaactcaaggtagttatctgtgaaggtagctttaggaacccattgttgcaggaatggtgaattgttgtatcgaaactcaatgttcttacgggcagacttaacaccgttatccatagagtcagatacataaatcattccttctactttacccaagctaggtagatgcccaaacactgctaagaacaaagtaaagtattccatgaacagagttgtctttgctgcaccacggaaacataagttagcaatgtactgattcttactggttatcttatccagcatctttaagtgaacaggaggggttttgtttgattccccctccttaccattaaccagcttaataaagttagcaaaggtcagtgcaaactcggttggtatatacgtaggggtattcagaacggaatagtccacttggtctagccattcatccaactcctgtttaattagttcagacatcaataatatcctcgtcttctcgaaccagtgtggaacctgcaattactttagtaggtgtaccagcttcaatagctgctttctgagcttcagccaactgggttagtgtgttcttgagttcagtcaatccagagttttctctcaaatccagattgatattagtaacagcatccttcggtttctggaggtgagtaaggatagagttggcagcatcacactgtaccttctcactggtagcattcttcatgagccatgcctgatggttcaatgcttcctgaaacaaatcctgattaacaatccatactggaatcagtgattgttccataatgaggtttactaacttacctctatggtaagcagatacataagcagagatgtccttctcactggttccccttgctactaattcagcttgtctgttggggaatgttttgaagtaagcatctttgttgctataccccatatgtttgtaagtaacatattgaacagcattaaggtaatcctgggtcttaaacttcccatccttcatcaccccagcataagtcacaaagttatttctaatttgctctgctgctgtctggtcttgggtcacattgttaatcatgtctaccagttggtcagtaacactgctcttaaactggggaggcaatgcagaaacaatgtctttcttagtcagtagtgtgctcatagtcttcctacaaattatctagagtgaagaggattcttttcttggggtcagtaccccttgcagaaacctatacatagatttagactttagactttctttagtctccttacaatagtaagacagagacatggggagcctattgcccaaaggaaccagtaacatgagactattctatagttttgacggtaatgaccaatggaatgagatagacttcagtaagataggtggagctatcccagttggaggggctacgccaggtgaccatatcttatgtcacgatgaggagtctttccattacatctcaggtatgatgttaatcaataacgtcactgggtttactgtccataaacctgcaccagtgcgtgtcattaccaagcctatcgagggtcttgcattctttacaagaatacctcaaagtatctctatcaaacgacagcgtgacgccatcgagatgaccgtggttgcttgataagccattgcccgcccaggagttggtggcgggaaacagggaactgtttgaataaccacttcagctacattcacccatctccaagacgcctttgttatctgccattgggtgatgagtagtatcagagagaactgatttaacaaacacactcggtataggaattgggagccatttggctccctttttcttttatgaaccaaggagttctatatgaacattcgtcctaatgaagtctatggtatcaacctagaatacactacaaacaaacctgctctgtttcactgtggctccaccaatctattccatgctatgtgtggtaataccaaacctctttacttacccgaatcagatgatacccatgccctgctaggtaactggttcttagaaggtaaagacattagtaccattcttcttgaaccaaggaagaaagtggcaatacctactaatgcatggaataacgaagtcatttacttcctagcaccaaaaggctttgaaccagtgatagaacagaatcactttaatcatgcagttactttctactttagagaggcttcaaagttatctgcttataaataaggaaagctatgtggtatataacagttaaaggtttatccgaaccagtgatgatagatagcctggcctttgtagaagtaggtcatcctattcttatagacggtaagttgtacgaagttgttagtatttataagagataaataggaagtctattagatagataccctataattttttcttagtgaaaatagtcatagttacttgtgagttcagtatt

SEQ ID NO: 14 - DNA, 135782 bp, artificial sequence
  BP1226
gacaagtttttatcctctttgtcaagtgctgcatgaaaaatttacaagcttgtatggtagcatttttgcggccctgtttacattcagttgtgtatgtataacccttgctgtgtgggcgtttagacgtctagacggttggaagtctgcaggtcaatatctaatctatcggctgctaactatatcccacacaaatagtaataaatataattgttatatgcgtaaacagtaactcatgttatcaatccctgtatgtatcaccagtggtgcgcataatgggtattatgttaaattgcccgtaatgataacagttctcacaatgataggtattctcattcccccacgcaaaataggttgcaaatgttgtgccactgtgtgaacggcctcacctattaatttgcctcactgcctcgatatttgagaattgttataagaatgagaagtattcccattccgtccgcctggcagcgctcctgtaggtcctgcaaggactctagctgaaagctagacccttcgggcctccctgtaggtcaggtcaaaatcgtggtagaattgggcctattcagatatttctggctgactcttcaggtctgtgtgggaaaagccaacctctccggcggggcagggggaggtcaattaaaaaatttacgtggtgtatgaagcgctcttcaggtaaggcaggtattatgggatgaaaccctcttcaggcaatgatatttgtgggtgtgatatttgctggaaagccagatatgacgggactcccggcggggcaggggtagtacagacagggaaaatatgagaatgtagttggggaaattgatcagacaggtagagtatggaatatgttacaagtatgttaaatatggaggttgaatatctgtaggatttgtgtgtaaaatcaaagacttaagtggtgttgtggtattttctataaataattcaagtttaataggtgatatttgtctctatccgctttgtgtggtaaacagattcagatgagattggtttacaagtgtatacataatatacaaattaaagatacaagaaacccccctcccccttcggctaccattcaccttttcctctgactggtacttaaacacttattcagactcttcaggttatcacccatatatcatatggcagtgactggtgtcctccggcccctctttcgtcacccgtccgcttcgccatgctaatgccatagctaatggttcggttgttcaccctgttcactcaggtgtatctctataccccttcaaaccgaagagaacagaaaacccgaattactcggtaaaagaaaagagaagaacttaattttatcaggataggcaagaatgtcaaggcatgactgctcactaaacaagcaaacagtcatgtgtgggggggtaagtgattgtggtggtaggaaatttagttgaaagatgtgttataggtgcttccagcactttagccgggcagctaattgtgtgtcagtccagcggttcatcctctacttcactgaaatcaatgttcatggtctcttcccaaccatcgatctcagcacaagagtggagttctttagggtttactcccaaagcctcagcaacagagtctatatttaacacctctggcaggtatgattcatcgaattcaaggtaaatcaggccacgagtgttgtcagctccaccaaatatctctatcttcataaaatctcctctgggaatgaaagtgtgaacagggttttatacgttctaatgcacaggaattatacacgtttgcctcttcaggccatgctttagcatgaggaacctgtgtgggctcggtgcttcatagtctaccacctctgaactcttcgtgctcaggcataatagagaaccagatatctacgatgtcctcccacgtcaggtcatcagcctcaggatctgtctgggacgaagatgaagagtcctcagaatctaagttttcctctttaactggctcatccaagggacatatggtcactccttcggatgtctcttcagatgcatgtgtgttgatcatgttccacccgtgagtattccggcaacagccgctatggaagtaatgatcatcaggatcaccactaaaacttcagacaatgttctcattgtgtattccatattctccaaactgtgtgtggatactatcacgggagcggtaatgtgtcaacagcaacgccgcgagggtttggttaaaatccgagcgtatggtgatttgggtcaaaacggacgtgcgttctcgctacgctcgaaagagagacttgtttgtagaaagctcttaaacgctctgtaacgagattatctgtccaaggtatgcaatcgtgcaccagataaagaaaaggacgccacagagcgtcctaggtgtcttaaatttgatattttgctatacccatgagggcttatcaaggttggagtagctgaaaggtgtcaaaaggtgactgtcaaaatccctcaaactatccaaatctttttcctcgtcctgacaccatctgtgcctacatttattgttgtagtgcatagaatgcatagcgttctgcaacttaacaggtacaagtgattcaggagtagatagtattgttgggtatgccagaatcacctcaaacagtggaaacacatcgaaactaaagtctacctctgcagaggttgatggcatataggagtatttagccgcctttgtagacataatccacctcacacaggtttgataatacctttaccgaataattcttcgtatctaatcttatccggatcccactcttggataatttcgaagacaatatccaacccagggataatcacttctccagtgtcaagtttggcaagaacaaaaccagaaggctgaatggtttcccagttgcgccgattggaatagaagacctcgaaaatatcgccgacctttatctgttgatcaagatgttcaagattctctttcatatagacgcagcggatttttcgtgcaggccatagaccacctgcatcacgttcatttagctcttttacagtaatcggtatacccatctcaaatctccttcatagatagtaaaaagaggggcccaagccccctctttgtcattattctacagagcgtttgaacagaatgtctgcctcagacatgtgctcaacctcttcttcgattttagcgcgacgtttttcagcctcatagcgaatatcgaactcggtagccaccagagatttgatgaatttaggagaatacaggtgatcctgcttctcaacgagaatgatatccttaatggcatctttcagatctttaatctgaagttggagttctaccagttcttcgattgttttgcgaaggcgatcacgctctgcagtgtcagaaggaagagaggtgaacagttcaactttagatttagccatagtaagagtctccttatgttgttttaaattaacgttctacaaaaataccgttcagttcaataaccaggaatttctggtcttcactatcgtctcgtgccagcacctcacagacgtatcggtcatccccatcatcatcgcagtcaaatacaagactgaggactttatcatggtaaaccttcgccactaccgcctcgtaagtattgccgattgtgaatccaagataatctccgatgcatttgacaacaacatggtctccagcatttaagtcaatcttcgtcattactgcgctccttgggtaataatactgtatgtaaaactttaaccagagatgtgaataacgccccaaaacacaccgatagcgctaaaacagacaaggccatcattaaagcttcagtaaaatcagtcattcctcacctcttgttagtcactatactatcatttatccttgtcgtcaagaacttttttaaatctttcagggatatctcccgttcttagatagttcatgacctcgcaaggttcccacttgaatttcttacagagcagggcggctgagattgtttcattgcgaaaagaaaggatattaatatcccactctgagaaccccaacttccgaagggtagctacagaaatcctcaccgcaacccagcagcaaaaacatgcaacaaacgccactgctacaacccacatcaggatgttcatataagcaccttactgaaatacaagacacagtgttaaggttactgaccagcaaataattaacagtgccgttgcaaccttggcaagatttatcatagtgcctctaagatttcatatccttcgggtcggaatacaagccactccgtggctccgtttggtcgatacgctttatacagaacaacctggtctcggcacatgcacatggctacatagttttcatccacacctgcagcctgcattgcatcttcttctccggcaactgctttgcttacaacttccttggtaggcaggtgtgcgatcagctcgtcaccatcattaattccaaaatggctgagttcgccgttggtatctttaatcttaatcttaaccagatctttcattagtcttcccccaggttcaaaggtcctaagatttcatatgccagattagaagttacaagagggtcttctgcgtctttagtattataccacccgtgaataaccagagtcccactttgtttcatgtccaactggaactcttctgccgtttcctcatccagctccaagatttccataaggtatttgatgttagggaggtatgcagctgttacagtcccctctaccagaccttcaggccaacctacatctggatgacaagtaggaaccaggttggtcagcttaatggtgtacgctttttctgcacgagccttcagtaacgggtcaatcttcattattcgtcctcctcttcggtacctgcttccagtaataagttaagaatatcttctgcacaaggttcatagaactcttggccttcattatcgatgattttgtagtcatctccacgaataatcaggggatcactctcaaaattatcgagacctttaacaacgacaacacgatcgattgccatcattgtaagaactttatcgacatcttcctctgctacaccatactgcagcagaatgtctttggtaggaggaacagcatccaccacaacgccgttaccaaaaccttctggaagtttagctaaaatatcttccggaaccacattcacatcaaaaccggtaatttctactttcatttacagcacctcttcgtcaactacttcataaaaatggcctgggattgcaatagcgttctcaccttcacctacaaacacagttccgtcaagaatcaacatcataagaatttctgtaatatcctcttccggaacgttgccaaaacctttaatcagctcgtaggttggaatatttacctctaagatgtcaccatctttagaacggaaatcaacaccgtcctgaatctctgccgtttcaaggtttttcaatttaatcttcatcaatcggtcccctgtcttgttaagatgaaggtattatttcacacagggttggcgttgtcaacacctgtgtgcaagaaaattactgaaacagtgcggataaattaccttctggtgggaacttatctgccaaaaacggtgttagcacagtagccttctgaagatctggggtccactcgttgttcagaacatcccagtagtacgcaatgttgctgtgtgggtgccgcattacgaactttttcccttcgtagtcatctgaaacctctacagaagaaataacaacagaatcttcaagggtttcttcatagaaagatccaccttcaaatttccaacgagatgcaagagcccctgccttgaacgctgcagataacggactgtcggcaagaacatacatttcttgcactctgtctctgcgatctttgcttcttacgttgtatacagtatctgagctatactcaacacggtataggcttaccattaccgcacctcctcaataacttccacatctgaacctaccacaaatgcaaaaggacaggtttcatgaaagatatccggatcgccgccaagcttgctaacaatttctccaccactaataaacacaagctcaccgatattcatcagattgctgaaatagtacccataatgattaaagaatgcagcagggtcaggtagactagtagcctcaagcactacatcggttgaggttactttcttatcatagcctatcgccttttgagatgcaagatctgcagaatcctcaggcgaccggagatgcacaggaattgtttcaccaataaagcgtactttcatattatcacccaacaaccatagcttcaaaaggagtcatgaacgaataaacggcatcatcatctgcttcagggaatgctcccaaagacttcatatctgagcccttgacaaatacaaggttttgatcaaaggcttcttgggggtcaatccgatacatatttcgtaaaatatcgcttacctcctcatcaagaggtgagtatgctgtgcacgtttttccgatcaagctttgagaatcagggtatccacctgaagttttaaaataaacaatcatatagtatcacctctggtaagagattgggactcctttcccacaaataattacaaatcttccttagcgaggaagtatgctaatccaagcaggattattcctctacaatctcatacacatcaggagctacaatcaactcttctccgttacccggtgcaacaaacaccaccaaaccttcaggtgtgtgctttttagccatctcgataacatcttctcgcagagctggctccatcagatcaaaaccttcacctagggcatcacgaaccaccttcatatagtccactggttgtgcttcaacaatcatgccttcaaccagtccacaatttttgtctgccagctcagtttggaataatttaattttcatttagaggtctcctcaattatttgatattaatagccgtaacctaacacattaactacaactgcgattgcaaacataatttcaaagcatgcaatctctacatttgggactaatttcttaatcacacccattgtagcacctcattctccaaagtcaatctttactttgcctttccccttacctttctttccaccgcatttagccagctgacgtgctgcaacatctaccatacggtcagttgcctcgtaagcatcactgcctttagccttggcaataacttcttttccagaattgtcaaaaatgaacgccataacttcctggtgatcattttcaacttttacactcacacgtgcatagttaacagagggatgtaaacgctccagcttggacattttgcgggaaataaaagataccataccttctgtgatttctacattgttgccagtgatttcaatttgcataacgtgttccttttaaggaagagggaataactatctctctttgaaaacaatgatactaaatctgaagcgttgtgtcaacagtttttacagcttgttgtcgatagtttttaaaatatccacagcaagatctgccatttttcgaacatactctgcaaactcaacaggatccttgatcaaagaattcacagggtcgtaccctagagcgtttaaaatggctgcagcatctacaaccttctcatcatttgcgaagatctctccgtcaaacttgtaggtccattttgagtcaaccttagcagagcagggtttgtccatgcttgttacaccatcgtctttaaactctcctgcgttatcaatatttagaattaaatccatcatggtgacacctcactgtttcagtttagcttttcttcaacaaccccataacttggggcagagtcaagagctttctggtttaaaagtggcgtagcagaatctgcaaacggtgtccaagtttttgttctggcattccagtaatgcttcactctggaatctggatgcactataacaaaaactttttcacttgtcaacacattaatttcttctacacccttgctgataatttctccgtcatagcccccagtctggtatccttcgtaccaggttcttgcataggcatagccagcatgcagcctcctccgaggtggagactacgtagaagtatttctcaaattctggaatacgcccttgctttacgctccaagccccgcgaattttcattgtaactttaaacagtttatttttcacaacggttacccatcacagctctacaatatctgcatctgaccctaccccaaaggcatagtaggactcttccccgaaataatattcaggtgcaccagcggtgatcaggtctgatcccaagataaacaccacgttgtggcctacataactgtgatgttgccgcacaggatcatcccacggcaacccttcaaagtataccgcaggaacgacctttccattcaggaaggattgtcccaagtagacgttagaatcaagaattttaaccttcatgatcgtcctccactacctctacatcctcacctagggcaaagttataggtccactgactgtcaaagcattcctgagatgcaccagcggcaataagatctgctccttttatttttaaaaggtcagggtaatcttcgttagggacagcagtaaacacttttcctactaaaggctcctgaccaatatagaagcttgaatctaaaactttaactttcatcaacggtctccatcaggtggttgtgggacgtaaacactgttacgaatatcgtcagcagtgtagtaataagtggttccaaccctgtctcgggctgcaatgtactctgctataccaataagtgccattgatttggtggcgtatcttcccaactcgttagctccccagtagaatttagaccagtagggaataagaccgaacaaatataccttttgacgaacttcccagtaagtgccttttccgacaagtttaaactctacttcactactgttaatctttttcattatcaatctccctctaccgtggtcggattgtcagtaagaaattgagcattggctggaggcacgcctgacattttccacacaaccataagtttgtaaccgggcactctattaagtgcagatcgagtagagtttgtgcacgtatactttcgctttccaaacccgttctccatcataatccagtacccagtatctttgtcaccaggtatcggtagaccaccttcatcaacccactgaatggaccacggcacgatggctacagctttatatttaaactttttaaaccactcaaaaagtttcataattcagcctcgcttggcaactcttctaccttaacatgccgaaaagtgttaccgtaatggttgatccatgacatcagctcgctttcttgctcttcctctgggatgaactctcgaatgctgacaagttttaagaaaacccaatcacaatctgcacccattctaccagacaggcaatagtgcttcataaaaccctcctgcctggtttagaatattgcttcttccattgcgcctgagagcaacaaagaggtgatctggctaacattcatctcagactctacttcctcccctttgaaaggttcgcggcagaataggactgtttcaggacttttacttcgaacaatataatacaaatcattcaatgtgttgtagtaataagtgttaaaacgtaagtttttcattttctagtcctcttcttagatttttggggagaaacgctttctgcaatacgagacagacgttcttctgaagccttacctactccaggttttttgagtggattatctttatgaccacaatccaactggatattggatacctctccaactttgtaagtcaattctagcaaaaggttgtcgtccttgtcaaatgtttttacgataaattttttatcgttctcctgaacttcatatctggtacctgcagtatacagcatggtgccatcagcataggatatccagatcattgagcctccttttgctgcaacagcattaactctttgttagagatctttactgctgtttttattgttccatcttcacgaaaccacgaccagaactctacagtgtcaccactatcaagtaaagcatgcccatggtaaaaatctttgtccttagacagtttctcatctatatctgcatcaacacattcgtgatccatagcattttgcctgaacgcatcggttatgccaatgcacgccttgctctcaagactggtatatccgatatcttttaattcagtttcccaagtccagtaccctataaaagctaaaacagctacccacagtaataacgttttaatctttggcattctctctacctctttcttagtttatttcactatggcacatcctttgtgccatatctcaactactacttaaatagtagttcaaaatagtgcaaaattaacagaagttgaactacacctagtgcaacggcgagtatgttaatcttagaatcgaaaaacttcttaacttttactctaaaaggttccttaatgtcctttacgatcctatctatagatgacctcatatctctgattaccatcctgaacattaaagacggatgctcccccatctctgtaacggaatcgaaaacatactctcttcggtcataagggccgccagctctgcgtattaacctctccacagagacctcgaacgtcacacctgtaacgtaatcatctataacaagtcgtgacgggtctttacctttactatcaagaggtatcaaagttatctttccagattttgttaaaatttcccctttttcaagcaaggtgtaccaatgctctctgccaagactgttgaggcacgtttttacatatttaacaaacatcgtcacccctcatcgcacgtctgatataaccactctataaaatcttgataccattcgccctctgagcgctccgtaggccaataatcttcaccctctcgtgcattaaaatctgagtattcaactttccactcctttaccagctcgtggagaaggttttcagcctgctctaaagatttattttttaccattgctgtctcctttttcaagatagttatacatcagaactgcaccacctaagatggctactagtaacaatatcccagatagcatctcaataaacatggcttgaaacactggaaggtctccctaaattaacgcaccattttaaatacatgctcttttcccataaaggtgcctggctaagatctgcgtagaacgcaatctctttaagaacagtatagatagttttaggtgcggtctccatccctactctccttcctgatattcttgtagtaatcaactaggcacattattacgatgaagataacaacaggccaaaaaggtgcagcagtgatgatggtgataaaatcatcaaacttcacccttcgtctggacacgatgcatacacctgtcaagaataccgctgttataacggacattaccaggtaacctattagcacaacatttatactcattggtcctccctttgtaggttaaattgtatactacaaattgtcgctgagggtgtcaagaaaattatcccgttctttctcagagttttcatgtgtgtagctgaaaaacatatcgagaataaccttattgatatattccagctcctctgtgttcagatgcttagcaggatctacaatgacatcccaaatatcatacagaccacactcatgatacccataacgccactcaattgtcaagctgagcggcaaatctttaccttcacaaacaaccttccatctacatatgttggtatctggtcgtacctgtgcacggtacacctgcacaaaatccaatttgaatttgaggtactcgtcatacaatttaagcacaaagctctcgatttgtggagacacttttgcagcaaactgtgcgtatttgtacttgcactggatgatctttctgcgttttgcagttaaattttttgccgccagttgttcttcagtgtatctccacctacgatcaacaaacgcaacagggtctttgtccccatagaggtcttcccagttaatcagaagcatacctgtcactcctccacaacttcaaggcctttaccgcctcgctctggcagattacttaaagataggtaatacatataatcaggagagatcctgccagactctgcacctgcagctagtaaatccttccctttaaccaggacaacattctcgtttgcagatagccgttttgcttccacaattttaccaacacagtcaaccaaggaagggtaccctaaatctgtaagaaatttaactttcatgctacctcctacctaccgtccctggtaagataaattattactgaacagagcgcggtgctgggaaggataactcttctaaagagaagatttcatttcctaccacccaagttgctgggtcatctggatcaacaggttggataatcattacctcatccgcctcgcacacacgtttcccacccatagcagcgtcagccactaacatacgcggctcttcagaaatgcacaggtagccacctcggcccactgttccttccacgggatcctgccctttgaccacaatgaataccttctctcctgtggagatattacttttcacactaacagtttgaccaactttagatgtaccgatcttggtggcttcaaacattaaatcccgaattactgttgcatagttgccggacactttcttaccttctttagtaatctcaatcttcataatctaggctccttaaatgaatctatgtaatcaattaaatcccaagcatcgcgatgggctgtcagagggtatacttctccgagagggatcatagcaataagtctatcaaaaacccagtctggacgcaacattttatggtgatattcccactcaccttccacagattttttctgagtgatcaggatctctgtgtagtgtttcgcctgtcttgagtagattgaaaatgacttgtacataaatgacccccctcttgttgaaaacaacaatacacaactaccaggttactgtcaagtaggcaaccgtattatttttctctggggagatgccaacaacatctacctgcagacctcctgcccttaaatctccaacaatgtgcgggaagtaatctgagagatgcgagggtagatttatcgaaaatccgcaccccagaaagcctgctaacgctttattttgtatctcccctacaatcgcatcataaatggagttaagctcgtcagggagcgttacagggcgttttagcgctagctggtgtaatttgtccttagcactcattttcatttcaggtctacctctgggggtgccaaccacataaacggcggcaagtctaaacggtttttcttatcccacacaaaatatgcatatgcttgcccgtcagttctgccgtttgattgaaatgatggacgcttagatattgtgatcacagtagtaggtgcattatcaagccaccattcaaatctggctttgctttccagaaaattaagacgcaaaagcataataactacgtcagcatctttcaacgccttgtctacaaactcacgagccaggctgtatggtgggttggtgataatacagtcaacatggttgtattctgtattcagatagtcaacaccttcttgtatttctccccatgcagatcctaacggcatacgggagtagaacacacctgaggcactattcctgcaaggctctaagtaggtccagtcttctgggaacggaataaggtcatacagcccttctgcacaccactccggtgtcacatactcatcgtaggcgttacgttgttcatcaggttttctagcacaagtcatgcaaatctccagatcataaaagccctccgaagagggctttagaattaatgtttaagcttcttcgacaattcctgcacccaggattttttcattgagctcttttgctgttttaataatattgtccaccagacgcttgcgagtcttatctttcaccttaacctcttcaccgccgttcagagtagtcttcaattgagacagaatatcctgaagttcaacgacagagaatctctgcagatcttctgaagtaatctcactcagggcaattctgacggtctcgccactttccatctgcagattcaggaacacagtgtgaacatcacctttcgaaccacccgcttttgcagattcaacagcatgaactaactcatctaaagatgtgcactggtgaatctccggaagacctgcttcacctaacacgccttcttcatcaccttttgccagaagctttttcggtttttgtccgttctggatgcgttgtatgttgccttcatccagaataatagctccagtgcgtgctgccagctcttctccgtccaaccacacttcgccaccagctgtgatggatgcgatctcatcttctgtcagcaccccaccgtagtatttttcgatcaggcgttcaaaacgttttttccagtagctgacctgagtattcatgttcacaccgttaccataagtgccaccttgatagtagtggaacataaactctgtgtccggagccacagtacgttctttacaaccaagccataagattgttccagcagagcagcacatcccttcagcatgtgcaacaacgcttgcctgagactctcggaatgcctgcagataagccattgcaatgtgcacgcaacccccagggctattgatgatcacccgaatgctttcttccggctgagccatacggatcgtctgcagacgagacatatgatcttgtaagtcttccaaatcgtcgatataaagaacgtggtcaacaacaggtgttgggtagctgtatgtttccatgataccgcccggcataccaaacattttattactcataggttcgaaaccgttctgtttttctttcatgccgtgtaccatggttctgcgaggtgttaaattcatgagaaatccttaatattggaagttgaaagctatttatttaaacctgattcacatttacctttatttagcaatcactatggaatacttacgattgtcagaagcatcacaactcaatgattgccagtctaccacataccacgtatcattgtcaacaattactttatcgcctgttctgtagcaagtgctgctttcaataattcgagactcgataaagaatctgtgtcggcgctcacgtagcaacgctaagttaattatattaccaccgctgtccttggtccacacattcttggatcccttatttgccaaaattgtctcgccgttatagacaaacaggcagtatattttattcagtttctcttgtattgtagccatactgtccttctctctgttttgtccgataataatatctaaagcttacctatttgtcaacaactgttttagatatttaagggtggaataaccacccttctgtattactcggaaacaggggtccaaatatgatttgcacgatcctcaataagattgagtgcgatctgacgacccaacccagaacgaacgacatcgtctggactatcaaagctgatcattccaacctcaggatctggatgacgagtaaagaaatccgtcacccatgcaaggccagatttaccagggatgtcacgttggctattatcacccataattacaagggtggcttgatcagagatccttgtgataattgacaacatttcttcagggttagtttgctgtgcctcgtcaatcaggacaaagcatcgctcatcgaaactacgaccacgaatgctttcaacttcacaaatctcgatacggctgttctgaccgtcccccagcattgcggcaaaagcacctttgccaacacgacgacaaatcgtgtccatcatgcttcgaagatagggccacagtttctgcattgcatttccaggtttaaatcctgaagtctttcctgtctgaacgtaaggacgtgcaacaataatcttatcaatctcgttcttacgcagaagatcacctgcatatgcagatgccatgaatgtcttaccggatccaaacacaccgtttacaataataatcttacgtgaccctagataatcaagatacttttgctgcttcttattcattggtcggagagctggagcggtgtgctctctttcgtcagcaaatttctcagaagccttacgcaggcgattagatttgcgagcctctctagcttcatcacgcatgcgttttgtttctttagctcgacccatgttgggactcctttcagattgagatgtgccaagtacttttactgcaatagtttttcaatagccgcttccatgctgcttgcaacagcctgaactcggatattcatctcttcttggtggatcagctccttaagctctttaatggtaaattctttagagaaaccttccaccataatcttgtgcaaggcttcttgcgtgtctacttgcaagaacttttccagtttgttggcagaggcttctaaatcagcccgaatacgagggtcatctgtgcgattcagcattaggcgtaagccatcaagattagtagaaatagcatctgcatgttgagtaactaaccgtggcaaaatgagatctacaaacttattagccaaatcgatacgttcttgtgtcactgttgcaccccctcttcatcttcatgatgtttcttttcacgcttgtgttttttcttaagctcaagcgcaatctctttcttgtacgccttcttcaaggcttttttagccatttggcacctcctctgctttcattacggcaattataaccaactcaacaaagctttgtcaacaactagtctacctgaacccaaccgcctgatacttttttaaacattctttggttatcactgcctcggaacggtttcttggttggtaaatcttttacatacttaccgtcaatgatgatatcagccagtttaagaacatcactagagatatggtcaaatgtgaacccagtatatacaagaatagttttcttgtcaccaaatttttccttaattttctccatcaggctaataatatctggctcattatagtatgctaagggttctccacccagtagagagataccgcacacagacgggttatctaaatctgacaagattttttgcaagtcttcttcagtgaacttcctccccttatcttttgaccaaaatgcctgattaaagcaaccatggcaagcgtgtgggcacccagatacccacaaggcagttctaatacctggtccttcggtgtaagatatttctgtgtatccagcaatgttcatagatactccgcatcacatttagggcaatgccaaataaaatcgtctagtgccttgcaccaacgaagattacagccgcacttgcaaattttataaatacctgatgacatactgcacctcctagctcactgtgtgtcaataatatgccacatccttgtggcttttgtcaagaatcagcaaccacaacttccgtagtgcttaactcgctcgataacttccgcttgcttacctttattgtaaggacgggagttaggactggaaaggtatccagacacacgtcgaattacactgatcgttccctcttcatggtttccacactctgggcatacaaagcctttagctgttgcactgaactcaccagagaaaccacacttgagacatttatccacaggttggttaataccaaaatacataatgtgtttatacccgaagtcaacaagagcctctaaagcatccaggttgtttttcaggttaggtgtttctacgtatccgatgttgccaccagaggagatcatagcaaaaccttcctcatactcccacttatcaaaaggagagctatttatccatactggctgatggaaactgttggtgagatattcatgctcgtgcttcaacacttccggatattcacgatccagacaggttgcagctttatagcatagactctcagaaggagtgccgtacaagctaaatgctagtctactttccttcttgtatcgctcacaagcatctctcatgtgctgaaggattccaagagctaaagccttgtcaccctctctgcccaaaatctgacaggtttcatacacaccgatatacccaatactgatggaagcgtacccgtcatagaagagtttatcaatactctcttcaggatccaggcgagcaagagcgccttcacaccacatgatggggttctgccctgcctttgttccttttagacgattaacccttacaaggtgagcctcgtatgcaagatccaagtattcgtcaagaactgcaaagaaatcaacaccttccgtcttggcttttgccgcaatcattggcaggttaaggctaacaacgcctaagttaaatctgccaaggtatttctcctcgcctgtttccaagtcattgtatttgctaagaaaactcctgcaacccatgctagttactttgccatctgtcgagcctgtcacttttctatttagtggtacagatacgaagtcagggtagatacgttctgcacagcattccagagctaatcgtttcaaatcatagttaggatccccagggttcatgttgacaccctcttctaggaagaacagcactttagggaacacaggtgtaatacgttcttcaccaagacccattttgtggactttcaggtagtttttggtaatcattctaccaaagaccgaggtatccagtcctaaactcaatgtgatgaatggagtttgcccgttgacagaagttaacgtattgatttgatagagcaaagtctgcatgctgtcaaatacgtctttatctgtcatttgcattgcaacactctcagcatttggcaaccaatgttcctggcaaaatttaaggttcttctcataggttgcttcagcatactgtgccagataatgatcaatatggctcatagtctgaccaccatattgagcactagctaccgcactagaaatttggctaaggattgttgttgcaacccctattgacttcggcttactgacatgggcgttaccaatgttgaatccgttttccaacatatctggataatttaccaaacaacagtttgttaacggactgatcaagtagtcaagatcatgcacatggatgaagcctttattgtgctcttcggagacacggtctggcaggatctgtgttgatgcaaggtgtttgctaagaatacctgcaagcaggtcgcgatgagtgtgtacatgattagtaggcttatttgcgttttcttttgtaaattcatcacaagttcgatccaagaagccactaatatctgcaagcagttttccacctgcctctctgttattatctcttgtctgtctatactggatgtattctctggctgcacattttaaacccatatccataagagcatcttcaacaaggatatggatattttttacagagattgtgcactggtcggttggtagattgttagcaacaacttcattaaccgcgcaggcgatccggtaagcttcttcttcagtatgtccagactcaagtaaggcggactctgccgccttgatcaccttaattccgttatagaactcttctctaccgtcccgttttacaactttcactttttctctccaaaaccattcttaacaaaagagatgaaatcgtcggcaccgcctatatggatactgtcaagatcgctttctaagaagatctgcggcaacgttcgggggacgattggactacacttctcaataagctcttcttttgtgtagccctcgccaagtgtcttatatacaaaaggcagacctttgctgattgcaaattcttttgctctgacacaatgtgggcagttatccttaccgtaaatgatgatgaaaaaagatttttcgcagctcatatattaaaactcccaaatttcttcttcagcgtcgttaacagttgtgttgacgcggtagtcagtgttcgacatttcttggttcgccgtctgttgcaatgaaggtttcatccacacctgcataaacggtagcgggtcctttgttggcggcacaaagtctttgtcgatgtcgtagtaatcataaatcggtgagcagttatagtcaacccactctttaagcaacgatgagttaagacctataatcgctcttccttcgctgaaaatatagtcactccaaccgtactctttggttcgtacttcatcaagaatctcttttaactccccctttatctcaaggaagcttttctcccatgcgggatcattaagcaagatatcaatgatggcaaaatcacctttcgaatgtagcatttcgtcaagcatgattttttgaacaagctgcgccacctgaacaaagataccctgttcagctactgcgaaagtgcatgcaaaacttgcaataaactcaatactttccagagctaaaagcgcaaaaagcgctctaagaatgcatttccgcacaatatcttcttcaacactagaaggatccaggcggtattttgcaccaataacctcaagctcttgcatgtatttgacaataacgccggatctgctcagaacgttttggttttcctgaatctcttctataatctcacgggcattggggaggcattgtctaacaatctctgagtaagttagtgcgtgaagaacttcaatctctgactgtttcatcaatagagtgaaaagctcactattagtgatgaatggtgaaaagaggcagatgatcgatcttgccgcaacgctatcagcctcccattgccacatcaaagtctgcaccatcacgtcataagttgactttgagcatgttacaaaatctgaaatagattgcgacaaatccacttcatcctctgcccaatcttgctctttttgttttttgtatagttcaaacagttgtggatattttttgttgatagagtcgtacatacccatttgctgtcccagaaacagcggatagtcaccagttttatgagcggtgttctcagcattaaatacagccattattctacctctaaaatggggccgaagcccctttaaaattatagtgcacagctttcgcaatacggatcttcaactgaactatctgcaatcaaaggatagttctttctggtttcatcttcagcctgtttcttggcatgaagttcctctgccaaggagtcaccagcaccaaccctagagtttaaataataccatgtcttcatcccgaatttagtggcacggataaggtaccctaactgctccttcattgaaattttaccatctttcaacttggtgtagtctatgtataaatccgcgctgattgcctgacctgtgaatttttgaatcacggcatacatatcgatcatgtcgttagtatcaacgtcccaagccgaggtgtaatactctttcaactcatcatagtcaggaacgataaacagcacctgcccttgtggcgactttttaaagataatgtgctcacggacaggataaaccccgttagtggtgtttgttgccagcgaagagctttcattaggcatatatgcttcaagaacgctattacgtagcccaccattctcaatgatttctttacgtaacccttcccaatcctgtttaagagaaggatctttcaccacgctatcgacctctttgttataggtgtcgattggtaaccaaccttctggatattttgttttatgcatccactcgcagacaccacgctcttttgccaaccgtaaacttgccttatgcaagctgtagctgtgaagttctgcaagatcgtgaacaagctgtttactttcaggagacccgtaagtaaccttatggctggcaataaaatgtgcaacattggtaaggccaaccccgatggatctgcgttttttaactgtgctttccatattttcatacggatatgtcatgatttccataacattgtcaatcataagcaccgtatagtatgcaacatcctcatactcctctggagtaaccctcccagctacaagagatgacaggaagcacaatgcaacctcaccatcatcaacatcgtacttgaagatattacgcatatctgaatagccttttgtcgggagggctatttctgcacacaggttgcttgaatagatcacatctttaaaaggtgtatgtctattcatctcatctgtccagtatacgtacagccttcccacctcagtacgctgcgtgatcagctcaacagcaagatctctagcccggatccatgtcttaggaatactgtcatctttagcaatacgctcaacctctgcatcgaactcctccatagacatggtgaagataccctcatgcagttgaggagcgtgcttataagaaacaagcatccaatctaaattcttagccacacggttgataaacgacctattaataccgatggagtagtccatggtgttgattctttttgaagcaacagtcatagggtttctcaaacggattagctcatcaatctgcgggtccagtgcaaggaatgatactgttgcagaaccgccacgtgattgttgtctgttctccttaacaccagcatcaatacctcgataatatggaatcttacccatgtgtttaatagtgttaccgcgaacaccatcacctgcagatcttgatgataaatagtagccgatacctgcttggttaaccgtcattgtgtacgcaacttcacgtgccacaccaatagattttgctgtatcgtcagcttttattacacaacaagatgcataccctgtcttacctgtgcgcagcccgtttaagtacggtgtcggggcattgatctttaagtcggacagataagtgtataattttacaacatcgttgatacgacgttctttcggcatattcttcatgacagccattgctatccccataaacatcatctggggagattcaaacaaggtgtctttaagagtatccttgatcccgtatttgtcgcgaaactgtttaaggactgcatagccataaccgagatctttactgtggtcaataacagcgtctaaagtgtttagctcggtaaagctatatcccatatcctcccaataccctttctcaaccatgtcgttgtaaaatgatggtaaggaagggatctttgtaaaccctccaaaagcctctttataaatctgaccaataagaacacgaccagccatacgggaatgtgcttcgtctttacggctaacacaggagtctatgatagcttggttaacttctttggttgtacatccatcatacagtcgtttgtatgcatccagtgcaatatgtgaccaattgccgttaccgtcgtcaccgaaaatagctgccttatttaaacgttctggatcgaatgccacttcacatccgttgcttttaattaccttggtgatcaatttgcttcctccacttcatcaacgtatttatcaaggcaggtatcagtatcttgctggataaaggtatcctcttctacagagatatttataattttgcctgtatactcgtcataataaacatcatcatacattttaatatcgtttgtcaggccgttgaaccaaagccaaccaacatactctgaccgacttgcaaaaccaagatccttccacttggagttatgactcatcttcaccaccttagctttcaataccgaataatttttccaggcgatgcagatcttcaaaattgaaaggttcatcaacaatatgaatatcttcagccttttcagattgttttgtatactttcttacattaacacgatcctctacaggaatatcatacggaagatcttgaacaagcattgcctcaccaggtgctttatccacatctaaaatatctacaccgttatacatttgcgggtatctaaagtctgcacgcatgacaccagcaaatacatctgcctttcgataatgtgttggcttatttttgcatcgaacgttttttccacgaagaacatcaatactttttaaatcaaaccctacggcaaagagtgcagctcggagaccgtttcgtgtgcgaacgttaaacccgggaacggtagataggaaatccaaagtaactgaaataaatgtctttttaggaatcataacattactcatctctgtctccatttctggctcaccaacaaagtgagccattattatagattatctaatactattagtcaacacaaaagttacctatcgctgtgataggattaacctttcacgaagtggttattaagcagttgtctgtgctgaacccacccacaaaagttggcagaccagaatttaccatcacggtcttgatgggttacaccttcctgccaagtactgatgtcttgtgtgatttcacatgaagacaggtagtagtttaaacgttccattgcgttatcgtgatccataggtgtcgcctggtgctcgtaagggcttgcatgaatacgatccccaccaatcaattttttagccacactgtctgccttttcaaacgtgctgtcaatatttcgataagatacttgtgcacagcaactagcactgatagccagagcttctttagtatcgagaatgcagagctttccttctgtgtcacgtacagcgtagttaaactccccgtccaaataaacgtgctctacatatggagtgtgccattgacccggtttaaggatttcaggagtgctattcacaagagcctcccacatacaattagctaacatctgaatcgtaggatccgcatcgtgccagcaacggaggtggaaaaaattattccactcggtgcttgttacaactgttttcatgcgctgaaaaggctccactaagcggttacatacttgcttatggtaaccagcaagggcaaacttctctgcatgccaagcggcgttttttgcagcttctttccaaaactcttccggagttagctccatatcagtgtactctacacggatcttttgatcgtgttccccaccatcttccattcctcgcttatttacaccgaagcgaactggcattgccggattctccacaatctgttgcagcatctttccgacaggcactgcacgggaagacatggcgtttcggctgaacactcggtgcgtcataagctctgagtgaataattcgaggatactctagctcaaaagtggtgatgcgcttacctttctcggaaatgctgtcagcaatgatctttgcagtgcacagttttagcattatttagctctccttgttttaattttggaaatttcgtctgggtttatgttggccttaaatgcaaggtatctgttgaacatatcggagcacatgtcttgggtgatcctggaggcatacaccagcttacctcccagatcatacacctctagccagtcaccgtatctgactacaggatcgccacctttagaacatctgcccatttcaaataccttctaaaaactttcctattttataccagctattagcggtatagtcaacactgacctttaactcctcaaattgctcataaggcgtatcttttagaattttaataacttcagggcgtgaagcgaattggttcaggtattcatgcctgtcgtcaattataacatctacagccacatttcccttgaaatgcgtggcgtagaagccgtgaccctgggtgtgatcgtccagatccataaaatcactagtccaacgctttaagaaccttgatttagatgcaaggtgacctttcttgcataccgagataaatgcaagcttgtgaccacgagccaccaaatctttcataacctcaatagccccatcttcaggcttaagaaagtcgtagaggaacgggtcactccagaaatcaaaaggccctatgatgttttctttggggcgatcaggccaatactttgacagatcgtaatacattaacccattagaaggtttagtgactgtcttactggctggaccatataaacgctccaaccactcccaccatgctgttcctgaatctaccagtgtcaaatctacatcaataccgattaacattcttcttgggcctctttagcatcaatatacttgcacacaatctccgatgcacattcccaaggtgcaccttcagggtttacaacatcgaactcaattccttttattccgttcttttccagacttagataggttctggaatcatttccccagtcatatccgacacggtgaatacggaacaacaacagatctccacctgtgctgtacgcgtactcgctaaggcatgccagctcctctttgaatccaccatcggagtaaacaacaacccctttacctttagggaaatctttcttcaaagatgcgactgcggctttaccgaaagcatcttcaccaaagataggtttaatcagattttcactacaatggatcatccattctcgcggagaaacatgcttaccgtctatcattaagaaagggcaaggctcttctttgtagtggcggtcataaagtgcattccagagttgaggagttacaccagctgccttaattgccacactgaagagcatctccttaacctcacggtggtgtgagttaggaatagcttccaacaagagatctgcaatgtgatccttaccactgctgggtggggcgttaagaacaataatatccatcaaaaacctccgtggtattcttcaactgcatcaataatacttttacacttatctaccagctcgttagccactacagcatcgtcttcccaaacagcttcctcgatctgatcaagcaatgatcgcatcttacccatcatttctgggataaagtcttctgaaaagctgtctggaattgttaactttagtgtcattgcgttctccaatcatactatgcgttattagaagtttgtttttacacgtcccttttcatcaacctcgttgttggctagaagcgttacaaagtctgtgaaacggacatgaagaactcttttcttatcaaggtatcctaaagccacccctgagaaatttagcatcaaaggggctaaagaagctctggcactgaaatgctgttgttctacccttccaacacccttagtgtaggatgggttaagattgtaagttctgaatcccagttttgttggagctttagaattaaaaacaactttatagcgtttcttactcaacttatgctccaggataagcattcccttatcacccttgataagttgaaaatctgtaaagtgctcttttaatacgaaaggtagtgccagtcccatcgcctgccccctttgtaccgctgtctcaccaaaagcttttgcatcagtaagttctttggtcaagtctatgcttttgatcatacctagtctccaaaatgtattgtagttctttcttacctatactcttcattccggcagtcttacctgcttcttcttgaaaagaagaatagcattcagcaaacactctgtcaacaccgtcaactaaagattttatgaaatatgttgattcttcagattttgggtcatcctcccccaatacttttccagcattatacccaacacgtcttacacagaagtcgtagtcatctggagtgctaaaagaaaataacttattctccccaatctctacaggatccctgttgcacgcctttttctcccaaatttggaaaacacacggcacgtcataaggtttgccattaagtagaaacgagttcttagggcacctttcactgtagacaaggtgcatcgacatgtccagtttgtttgcaaaaaatattttttcaaatgtccgtggcaagatgaaggctatagcccctccaagctctagcaatgatgcacaatggttaaagaatttgcaagctaaagatgaattcttgccaaatggtgggttacctatgaagacatctgccttgggatgcacctccaagaagtttgcctgaatgcacggtgttggtccttcaaattcaggatctggtactagatcgtaagacagtatctctgaaaatagttttgaaaaagaaccccttccagcagaaggctcaacgtatgcacaatttccatacttatcttttactttaccaacaagatattctgcatactcagggtttgtgtaatatttgtcgttggactctttcttgctcaaagtgcctccaaaaggaaaagggaggcgcaagcctccctatacttgattagattatctgaatcagggtgtttttcatttcttctctggtacggatgttgttacggtcacgaacaacagatccacaaccttcgcagcgatatgttttaaatgcactcagttgagtatacgccaaagcttcttcctcgtgaaggtgttctccaccgcagcgtgggcaacgaacttttggctcctcatcctggtagtacaatgacatgttggggtgctgcttagcaaacgggcgtgccagcaaatacaggccttccagagataggatatcaccaacattgtactcccgcatctgtttaaacgcctcaagatcaccatgaacacacttgatccacatttcaaatgtgtggtcaatcagtttctgtcgggcaagttggaagtatttgcatgcatactccaaagtgtttgcattcaaacggaatgccttcttgatcattttaagggtgtcaacctctttgtatgggcttgttggaggcaacccgtgaaatgcaaatcgttggtttgcccacccacagtcaaaacctgaattgtgggctactgcgacatcacatttatccagataataccacaagtcctgaatcaattcgaggtcattgtgaatatcatcatcccacattttgtaatcgggaagagcgcagtcaaccacactaggactgtctaaccacttacctgcgaaagttagcatatagggcataatttcaataccgcaggtttgaatgttggtcttatagtgcccaaagaaccagccgtttgttggtgatgtttctgtatcatacacccaaactttagctcctttgtgttcttcaaggaagcgctccgttgcttctcctacaatctctgacatattctcttgtgcacgtttaagctgtagtcggatccaactctcacgtgactcacggcctaaaaattcacgagcaatttgtctattagtgtatccctgctgctttagtgttaaaatttgctcaagagttaactttgtcatcatcgtcaaaattccttagtaaaactgaagaatgtcttttaaagcgaagtcacgatattcgcccttgtctacatcaaaggcatgcatcaaccactgctcttctttatgatactctgtagagccaaaccataaattaggctcagtaacgcagcgatctgcaacaacacctttccagttacggtatttcatcctgatcaggactgagtcgcaaggattgaatacctttttcatccccatagaaatctctctcctcagttttctttataaactcctgcatgtaggactcaatagcctcatgcttggtgcactctggattaatgacaagattgagatctgattctgctcgtgcaataatcgtagctttagagcatctcctcaagaactttgtcatatcatctctgtagtttttgtggagcgggaagtcgctgtagtctttctccagatagtcagccatccggcgcaacgcctctgataaactgcaatctgtatactcgttacagtatttcatccagtatttaagcacatacccctcaaaggtattagtgcactgagacaaaacacccctgcaacgaccagtcagatgatcatgatctaaacaaggcttacgaagtggctcgcacaagatcggatcaagaccatcctgctcctctgacaattcttttcgaaagttggctatgtccttagaatcttttagccacccgctatgaacgggggctttgacagctttctttcttattttacgctttgcgataacccctccagatgcgccctgcctatccaataagcatctgcgagatcggccttaccttgtaccaaattgatcccatctaggaaccctggttcagatacttcgcaggccttaaccatcaactttttatccatcgtaacaggtttcttcacagtatgctctttacctgtctttttgtcaagctttttcttctcctcaaaagcaagttcttcaggaagatgactacgagcaaactttttggcagttgttggtgtcactgtgtgaaccttaaacaggccgtcattttcacaatcagctaaagcatcccaaagcataacttcaagaccgtaaaacaacccagccagttcgcgtgtggcatccccgcgtgatccaaaggaaagcccttccataaccacggtgtcaacgccgtgcgtgtggatgtaatatctgacctgtttgcagatccagtcaatacgctcagcagctgttgcaaaagaaaccgtccctggtttcttctcttttgcagatgagctttgagttcgtaacacaaccttatgaacaggctttccatcgtcccatacaacgcaagctgtgtgtgtcaacgactggtctatggataatagacgctctctcatgcttcctcgtcctcctctccttcatcaggagcataagccttatctttgaacaagacgagagagcaaagcttaacatctgtttccacactggtgaacatgcataaccgctcgccctcaatcagctcacaatcctcttttaaaacagcagaccatacacggtcatctgcgtaatcatccgtgtacaggatgtatgaaatggtgtcatcttcatacaaccgccacatacctgtggcaacaacgaatgtattttttgttttaagtgtccctgttgtgtgatcatcctcaaaaacagcttccataattgcgttatctacagcatttttagtcatcagattgctccaacatttctaagaacgttaacaagttttgtctggtcattaaatgtccgcttcatatacaaacagtcaaaaattatactcatccattgacctacggaaattctacgatcaataccattgaagtcagtatacttaacaacacctttcgggaaccacttcttgtactgatcaataatagccacccacatctcctttggagtgctgcactgagacagtaggtagaatgctgaggcatccccgaacttacccttaccgataagtccttgatacggcttgatgttgtcagcagagtcaccacacagcatttggtatccgaagaacagcatcccgtaaccgccaacctctccattaggcttcatgaagatgttccccataccgttatcgatcagcataggggtttcccttacaaaatctcccttatcgtttcgcatgggatcgaacacaagccccggtagtgttctttggtccttatcaatagagataataaacttgttgaacttacctgttttttggtagtggttccaaccttcaaattgctggatagctaaccagtcgtcagcctcgataccgttgatcacttgagcattatactgcttttggagatactgtcttgcatctccaagcagcagtggtcgaagagtattgttacggttggctttatatctttccggcatgggaagatctagtctgaaattacctgtgcctccaagtacccccacgcaccgatcttccggaataccgagataattaaggactgcattagctttacacttaattgtgtgcaagcagttctctacaggatcaggggtttggatatccaagacatcgaaatcttctcgtgtccacggaataaactccttgccagcctttttacatgcagcttcacggttggtattctcagcttttaaccaaccaccaacggtgttcttctgccgcccccagaactctgttcgtgttttaaacatcttcttacgtccggaggctttgtgtgttacctcaattgtccttttttcacaacttgctgcagcttgatatgcaacctgatcgaagtcataataaactatagcgtcaggttcaagaagatcagccagacaatctatggactcaataagtggatattctctactcaaagaccctcctgttagttattctgcaagatggttggatgctgtaatggaatgcatcatcactctctgcaataagtgactcaacatcccaatacttttcaaaaaggaacggattagacccccagtggtgggttattttcatcaaggagtctggtatcatataaccacagatcttaattacatcgccaggttgaattgtgttttcatgaaggttgcttgccttcttcagaatcatacctttatgattctcgtttgcatacaactggacaatatctttatcttcaacaataaaaattttaagcatatctagttctcctagtttatagatatctgaccgataatatcagattaataacatttttgtcaagactttttagtctttcttggagagctttttgttgatcttttccttttgtggtagattccaagtgcagcgttttcttgggcgcacgttttaacagttctcagagaagaactttcagctttaggcaggtttaactcccaccaaccgagccagtaaagttctgattccgacagctgctcagattcagccttccgatacaatgattgcatacctctaatgatgtcgtccagaggtgtatcgaatacaaaagctgtcttatcgaatttctcttttacaggtctcttagccatcaaggtaaccctctatccacgaaaagtcagtcttccattctggaactttactaagctcacgccactctgcaaagcagtctcggtaatacgcctctgccatactcttggtgatcttattcaccttagccaactgattaactgcctgagcatactttccacggatatttgctaacccaggatgcaccgatgtgtgacaatccgggcacagtgctatcagtccgacaagccggatcactccctcttcgaaagtgtaaagttcatgacactccactgggtgtttgctgcctttaccgccgcacacctcacaagtgtagttggcttctctatagcacttcttacgtatcttatcccactcactcttcttcacagcgtttcggaggttattataccaagctgtttctgggatcagttgcacaataagcctgcgttcagacttcattaaacgtccgtcttccacgtgttctccctcattcaaagaaatgggtgcgagggcaggaacctgcctcaccttgtttcacaagctcgtagagctcaccttgacttgtctcataaaggcaaatacgtttaccattgtcccgatatacatcgacaagatacgctgtttcacctgcaaacacgacaccacaggacagacatgctaccatgaacaaaattgccaacagaaaatctttcatggttaagccctcctaaacattttatgaggtaacaataccacgtccgtgtggttatgtcaatgatcaatcaaggacaacaccgcctgcctttttaaacacctcgatcaacttctcgatcttctgttcatgctgaccatatccagcaccaggtaacgaagcccagcgggaacggcatttatggatagcctcgtggatacgcccttcgtcaatgtcggcgagagccttgcactcacggatcagttgcaacgcaatcttgtcctgactggcggggccaaaatctggcaatcctaactgttccatgtagtgtttagcaaacttctccaaaacctggtaacgaccagcagcggaggaggtaagtttagcatttagcttaacgtacacacctggatgcttgctgtaatcgctaaacagcttgccaccaactatgacatcgtatccccgatccttagtgggttgcctaccattatctgtgccttccgaatatgcgatcatgtccaagaaagcttttcgttgaacatttttatcaagtttcatttttcatactctccagtttactcataactaacacgatcaacaacactacacagtgtggttatgtaggtgccgattgaaaaccatcattcaattggctaccgttacctactgaaccttcctacatcattcaagcacctcccaagtgtctgggttaacatttcggacgcagataccgacagggaattggtagttgttgtcttctgtccttgcttggtatttgaaggtgacaaacttgccgatcatttcctgcatcctgtcatagctacgctcctcgtgcgtgcctttcatcttcattttaacaacaacaccttccttgtcaacacagataagaacaccttcatcattcttatctttctcaacgtcaataactttcacctctgcgtcgttgaactttttccatttcaatgcttcagatgttcgctgaccatactcatatttaccgcagaaattacgcatgatagtaccttcatatccttcggacatgaatataccaacagattcttcgcaatgatcaactgtgtacgcaagctctgcgtcaacaaccttgatatgatcaagcagcagagtggtaacggtatcctctgcatccataagatccttgcagcgtccagactctgtttctggatcccaccacaccttgtcgctaggaatatcaaaaatgtgatactccagatcgtagctacagtatccaccgtaacgcaaatcatcacgaacaggctcaacatcgacaggaatatctaccttgttgaagtttttgtatgttgataagcctgccttaattgctgcatgacggcgttttttatctgcctcatagtctttatcgatctcggcctgaatctcttcctgtgtgcgccaccgtttagcaagagacactattttctgcaaaggaagaccatgaatgtatagttccccatcaagttgtttaatcccagtggtagaatggaaagaacgaagttgctctaaaagctttccttgaatagggtaggacttattaccacgggaaataaatttaggctcaccattttggaaaacaacaagcagacgaaggccatctaacttacgcaagatccagcaaggtaatttaagtgccttgccactcttcaggtagtcatgcaccagcataggtaaaagatcaacaccctgctcgcaatcttccatgttttcaacataccccagacggacttgtttttcccacttgctgatagcctcaagctcggcctgttgctcagctgtagtctcgttggcacgacctacgtttttaggtgtacataccgtctctttgtactgcaatttaccgtcaagcttgccaaactctacgataaccttttcgccatcagtgaatactttccactgttggtagctgccatctttgttcagtgcgtacagtgttgttttgatttgatgcattactcggcctcttccttaaaaattttaaacatctcttctttactcattaccaaccagtctcccataaagtcaactaaccaatctccctggtacaaaaccaagttgccaaacggctcaacaagctcacacatgcgacgaatatctctggtccgaacaggtgacgatgtaaacacacctgtatcaatccaccgttgcagatcagatactgatgaagagcttccatcaaactggtgtgcttctacaggtttagcaagattaaataacggcattgcagtcctccttctgtagtaggtcttttataggataaacaagtaagtgtggatcggaataacgtatagtcctattctgccacactatgaactttattacaaccaaatttacaatatctttatcaccatgtagcccaacacacacatttgtccatattttgtggttgaagatcttgctatcgatgtagattttagtgtcaaacttatcttccattctacctataagtttgatcagctccttcatctggtcgccaaacacagcatctttttcaagatctctggaatgcttgtacataactaactacctcactgcatactttccataataagtaaagccgggtaatcccggctatgttgttaaatatactctgttacatccttgaagctcgaaggcttcataatcttacctttactgtcaaggaatataataactttattaccgttgtagaactcctctttagcaacgaaaccttcgtagcgaccaccaaaacgacgctcaagatcttcaatctctaactctatgagcaattcagtagacatatctgcactggcaccgtgagaatatcgtagatggttgatccgtgcaaacttgctgtcattagatttgagaaccttccgcatcatcccacacacatcgccgcgaagctggaacagcaaagctgttgacaactccgctaagcggtaagctgacgctctttgcttggatgtgtttttcgcagcgatcagtgtatcatagaactcaccgatcttgaacttaagacctcgtggattatcaaacaggtttgaccacttttcgtgattatcattaacaagataagcggcataacttgtgacaacgtgaagatcgcaggcctcttttagcaggtgatctccaccatcacctttctccagctcttccaaaacctcattgaactcttcctcaatgaagctaagctgtaattcgaatggtgtgtatgattttttcactttagctgccacacggttccagttttccacccagttggcagaccaaaggtagttttcaggctgagacagtttttccaggttgtcgatcagtttagtattcagcattaaaggtctccttttaaagttccataaagttttctacggtctcaatgaatgttttatcagagaaagcgtcaaccgccccgttaaaccaaaccgggatgccgcgatcctcgtactggtaaatatcactacgtgaaatgccattctcctctagatgctgtgagtcgtatttgttaacgatcagcagtttggtgcccttattgcaggcagggaatagctcccagttaaaattgataactgtgttggaacaccctacaaggataaccatatcattgcttgtaagagaagtcaacaggtcatacatgtctgtatacttcggagctacttctccgaagaacaccacattaggtttaacccaggtatactttcctgcatctacctcagagtatccaatgtccttaatgacgtcacttccttcatcgtcctcatagactatttctggcaaatacccgtgaacatgtaaaatatcttcatgttttacaccagcacgctccagcaaatcatctacattggtggtaaggttgatcacacgaccagaccagcgggaataccactcagcgatccgaagatgtgcaaggttaggctcaacaccgcctagagctacacgacgtgcattgtaaaagtcatgcaccttgtagtagttcttggcaaaggtgtggatgttgcacacctcatcgatgctgaaattctcccacattgcagtgctaccagatcggaaagtgggaataccagattcagcgctcaaaccagcaccggagataataatcagtcgtcgcataagtgtcctcagtagatgttttgtttaatctctattccaaactttttaaacgagtcagctgcaagcatgaatttacgagccgctgatgggttagaagtatgcacgaaaatcttcacgttgtcaactacagggggcttaccaaatacaaatttttcctccaacatagataggcaatcgtacccttcgaacaactctccaaggtcgttgtccatgtgccactcagaaacgcgtctgtagagctttctattatcgttaataaaatctataaactcggaggaattctttagccaaacagcgtcttggagcccgtaatttgacggatctctcaagtcatccagccacacaatcaacttcttcattgcatatagtcctcgttgtggaaatagcagtcaagtatctcacggcgttcctgctccaggaggcagttccatacatcctctgtgtagttgttacgaatgaagtttaccatgccgtaaaactcttcgtcaacacgtttaaagatatcatcatcccaaatcttccaagctttacccctcattacggcctttcgtgccagatagtatggagacttgatcttcaactgcagatcataagggtagtaaggcttacgaatcatatatccttcacctcttgtttctgcagctaactcttttgcatagctgaacggaatttcacgcacagtgtgaggacgttttgcaccaaggtatttggcaatcccatctaaagcggcttctggtagcattattccagaatcattatatctgcaacctatcaaatatgcgccatgatcttcctgaacaatatgcggatctgaagggtgacaaatttcaaacatgaatgtcatgttttcattgcccataaccttcttgataagatctaaattaccgcattgctcctggatggtttcctttgcaaggttacaatatggggaatcaagagacccggttgttgagaacaatagttcacctttatgagatgacaccacaccaaggaatccgttctttttctctaccgccgtcacaagcttattgtcaggcaggttggtggagttttctcccaagttaaacacttttgtgaagggccatgccacaacatttccttcattaccgacaacaatgcctcggcactccagtaatcgaggagacaaatgccataagttgttgtagaatacttttctggcatatttatagatctttaacccaagatctgggtaatatctgctggttacaagacctttgtcaaccaggtcgtctgcattaaaatacttcatcatacgttcctcatttgtcattttgtccctttatcctgccacacaaataacccagtgtcaacacttgaaattaacaaaacagttaggtatactatcattgaaattaaaacggagggttactatgtctaaaatgctatatatcgtgcgtggtctaccagggtctggcaaatcaacactggcaaatgcgctatctttagagggtctgtatccacattttgagaacgacatgttctggtatgacgatgacggcaattacaactgggatgcaagtaaagtaacactcgcagcaaaatggtgcaaagataacgtagaagatatgatgcgtatgggatacgaccgtatcgtggtaagtaatacgtttacaaaagaaaaacatgtgcaggaatatgttgacatggcaatcagtcatgggtatagttataccgtgatcgtggttgaaaaccgccacggtaataaaagcattcatgatgttccagacaaggttgtggatcgtatggaacgccagcttaaaaactgcattaaacttaaatgaggaatgtatgaaatactttgtaacaagcgacacacactttctccaccagcgggtcatggagtttgattcatgtcaaaaacacagatctcagtatgatcacaatcttgacagtatgaatgcgggaatcatcgccgagtggaactctgttgtgtcacctgcagacactgtgttccacttgggagatattgcgtgcactaatgataagaatatcaacaacttacttccagatattctaaatatgttgaacggacatattattcttgttcgtggcaaccatgacacaaggacgactgtcagaattatgaaagagttcggtcatgaggttgtagattattacgagcttcgccacaacaagaatttgatctgtatgagccattaccagtttgcaaagtggaacagaaagcctcacggatcagtccaactgttcggtcatgctcacggaaccacacaacagttgtttggcaggcagcttgatgtcggttgggatgtgtgggggagactcttaccattagaagaggcataccgtattgcaatgagttttgatattgacagcagggagtaatccctgctattttaaagaaaattgccacacaaggagaatcaggagatatgaaagatggggataagctgctatatcttaaagtcccccttgaaatactatctatgtcaaaagttttgaatgacacaactggggaggttgttgttcttgacttgtatgacaagatcgtatactgctacctgcacaactggtataagcttggaggaaattcacgcttcacaccaagcacaaggaaaattgcagcagatgttgggataaagaaaacaaaagcagcagcgtgcgttaaaactttagaatgtgcaggagtggttgaaacatccacacaagggagaggtaaaagatgcacattttccaaagttttgccaccagaagaagttattcggatgtcaacaactggttagaccagtaaaaacttaaatatctgtactataaggattcgtatgttttatgttcgccatggaacggatactattaactgtccgtgatacggacactactgtccgtcacgcggacacatctgcccgtaatacggacactaactgtccgtgatacggacacataaagaatataactaaaataactaaataataaaaaaaaaataaaagatctagtacttatggtactaagtacatatacttaacttatgtagaatatactagatcctaagtaccatgttttaaatttattacttactatgggcagtgtcggcccttcattggcactcgcctacgaggggcgagatgccgggcctctttggtgcacacaataacagaagttcatacatacaggtctgttaacatgtgtgggagcgaagcgatagcgcaggccaaaggccgagcactgatgtggaccaccgacgaaagcttgccagcgccgtaaggagtcggttgagagtctcccgcgcgagcttggatgaagtttatgtgtggaaactgacaagaaggcccctaaatcgctccacagctatataaactataccaggtaatgcaatcgcaccagtttgatagaaaagctcgttacaaagcgatacagttagtttttctataacttgaagaggaggcagctatgggttcacgcaaagatgaccgtgaaaagattgcaaaacgttatcagaatgaagaacagatggagaaaactttcaagtggaagcccggtttccagcgtaatcattctaacgctcgtgatcgtaagcatccggataagtggctaacaccgccaaatgatggcatgcaggttggggatgagaaggagatgtcgcctggaaaagatggcaactacattcgcactaaggacgctggtccaaaggatgacagctatcttgtagataaggttcttgatggtatcaatgtagatgttgacactgcacgaaacctttttcttgggtggtatcgcacaggttttttcgacatcaaggctattcgtcgtgtttgtgatattaaaaagtctgcatatgatgacgactcgttacatcgcaccctgagacaatattcagaaagatatggtcatccggttatcactcttgacgatgttaacgaagtgatgtatcatgcagaggttgttgcaggaagatttggtgatgcatatcttgatatcctttctgcaaaggatgaggtaatgttaaataagatttactatgaacgctgaggagcgcttaatgaacaacccggtagcaaagaactgtaataagttcaacaagtctgcaattcacactgacaggaaaaagagctggtctcctgacattgacgaggagcttgagagttactttgaagacctggccactaatgcagatgaggttgcgattaaagaatacgcagacaggaaggataaggccggaatctgttgacaaaaatagtgttacctgataagatctgcaatatgatgtgatgcaattttaacttacgaggtctacaggtaatgctatgtttaaggttaagctcgtttttcgttccatgaatgaggattatttagaagatgaaggtgaatttcgtgcactggatgatgcaatagattttgccaacgacttagcttgtatgaatacgggttatgggctatgctgttgggatggtggtgttcagatcggtgatagcaagatcttctacttctaccctgagcctgataacaaacaaattaagtatgttttatttatttgtgctttacaatgaggttgttttcgtgtatcatgatgaatatccaatttaaagatgaatttgatggctttatctccggatgctttgaaacagggttcggagaaggctgagttccccttagagggcttgatagtgcaccacacttaaaatggtaggggcagccagcacatgacgatgtgaccccagtcaacctgtaataaggtcgagccaaagtgcggtaatgggctctggtaacccacttgttgggtctttctggtccaggacgctggacaagtcgcagggaataccaccctgcggcgaacttgacaatcagtatttgctatgataaaatccacctatcacgtgataatggaggaaacatggcggatacaactaaaaagcgtcgccgtagaggcagacctctgaaagaggagtccaacgccattcagctagagaagaacatccttgatatgaaggaatcttttatagcgatggttccagaagctcacaaagttttaagagagctgatgttggacccgaaaaccaaacaaaatattcgtcaaagcattgcagagtatgttcttgataaggcagaccgaatgcaggaagaatatgatgagatgtttggtgaagaggaagaggtggtagtagaagaggctgaaaaaccagcaccttttatgccatttaccacagaaatacaacctgttagcaatagctaaaatattttcttgacaaactttgcttaacagtgtaatattgtaaacatggtctcccaccttttctggcggctaaggtgtaaaagaaagccacccagtgccctgttagcttagtggataaagcagcggccttctaagccgttgacactggttcgagtccagtacggggtgccaaattggggagttatcccgtaggggtagcggtgtagactgtaaatctattgtcattgcgactcgggtggttcgactccaccactccccaccaaatttatagttttaaatgcataaatcatacagataatggcattgatatttatcgtcgtttatactagtcactaactgctcgaaaatcagtgtcattatcagtattgtttataaatgagggtagggagcaatggtgctcaagcggtcttgaaaaccgtcccgttgaggatgacttgatgatggttcgattccattaccctcagccatattgttgaccttgtaattaagcgaaagccggaagcagaaccggattatcaaatgttacagtcgtcatcgccgactagcaacatggtcaacatactgagctaggtaagccctttggcaagggcgaggatttttaatcctgaaaatagacgaggtagtcgttgaatacataggtggttcgattccatcacctagcacctttttgctgatgtagcacaattggtagtgcaattgatttgtaatcaataggttgcaggttcaagtcctgccatcagcaccatggccctgtagctggaaggttcaagcaagcgactcataatcgccagacggtggttcaattccacccagggccaccaaataataaatactccgcgtagctcagcttggtagagctcctgatttgggatcaggaggtcgagtgttcgaatcactccgtggagaccactttcagttatactttaaacatatacaaacaaaaggaacctttaaaatgtatacacttaaaattgtagagcgtgtaaatccaacccataccgtagattttcgtgacgatttcaatcctctggctgtaaatcttcgagagtcatatcatgaactcagctgcgatgcagtggtggtcttttttgaagacaactctgaaggggcggtagcttgtgttgttgatagtgagcagaagttttatatttacagagatgtagatgcatacttgatgaatgaaaatgcagttactgttagaattatccaccgagtgcctcgataagtattagtctccttttagttagtttcgatctatttaggttactcaattttaacccgccccgttagctgtatagctgcggggttttttcgtttctggagccttaaaatgatttcagttttaacatggctgagcaggtatagagggatcataaaaggtttagtttttgcagctgcgataggtacagcttatcttggggccgtgtattggtttaactctaagcttaatgatgcctaccaagaaggtgtgtcagcaacagagttaaagtgggaacggatccttgatcagcaacaaaagcaggccgacaaaattaaaatgggccacgcagaggaggttaaaaaccttgaaaaatccctttctgatctacaggataaattaaatatggctgagaaggcaggtaaagaaaagcagattatttacctccagtcacctgagggtaagaagtcaacactccctgatcagcttatagatatttataatgagagtattaatcaggagggtagatgagagttgctacactgtttattgtgtgcttgttattatgtgggtgtgcaaccagcgttgagagagaatacaagattgaccctccggatgtaggaaggttgattgttaaacccccggaaggtgccatgaaaccacctgctaaagctatgcctttgaagaaaggtgcgccagatgcagtgaattctggcattatgagggataataatctgtcttgtagcaatgatagagctaaattgatcattttgcaagactatattagaacactgtttccaaaggagagaggttaatgtctaagatttacggaccgtgttctgaaaagcagaagatgatcctagaaaacgatgcagatattttggtaatcggcggtgccgcagggtctggcaagtcgttcctcttgcagttgatgccacttaaaattattgatgacccacacagctctgtggttatgttccgaagaacaaccccacagttggaaggtgagggtggactatggcctaaagcagtagctatttacagtgatctgcctgaaaacattaagccaaagttcagagagaaggatcataagttcatttttccacggtttgatccgaacactggtaagtgggatagaagcaaaaagggagctgttgtaaaatactgccatatggagtatgtacaagataagcttaaccatcaggggcttgagtacaccatggtttgcttcgatgagggcacgcagttcgaatgggagcagatagactatctgatgtctcgtctgcgatctcagtcaaagtatccatcaagaatggttatcagctgtaaccccgattcagaacacatgcttgccaaactggttagatggtggttggacgatgaagggtatccagatccggagaaatgcggtaagaaaagatattttatccgacgcgacggtgaatttatctggggagactctaaagaagagttgatagagaaatacaccacggttaacggacttggcgtagagatcaagccaagaccgttgtcattctcgttcataggcgcaacaatattcgataatcctgtctgtttgagagacaacccagaataccttgctttcctcgaaggtctaccagagctggaaaaagctcagcttctccatggtaactggtttgcaaagcctgagggtgcaaactattttcaaagatctttccttcgtgatgccgatagagtacctcttgggtcagtatcttgcagggcatgggataaggcaggaaccgagagaacttccggtaataaatttcctgactttactgccagtattaaggtaagtaaagatagcgacggcttttattacctgtccggtgattattgtcctgagaacgtggatgacgggaggtattccacaggtctggaaggcaagttctgtaaaaaggctggtgaacgagatgtgatcatcaggaaacaggcgcagttcgatggtgatgattgcataatcgtcttctctgtggacccagggcaggcaggtaagagtgagttcttaacctcctccagatccttgcttgccgaagggttcagggttgaagaagacccaatgccttccaacaagtctaaactgacaaggttctcaccttttgccaatcttgcccaacaaggaatggtgaggattgtaaaatccagtttccatcctgatactctggaagcatttctgactgaacttgaaaaattcaacggggaaagatcaacatttaacagaaaagacgactgggccgactgtgtagcttctgcgattaatttcctagagaaagaggaggtagcacttccttgtgtgattccatcaatctcatcaccttctatgttcaagcgttttatctaagtgttgccaatcttaattagatgtggtacaataaagtaattggagatactagccctctgacgagggctattttgttatactgttttgaggggtaaagcttgtgtccaaaaagaaccgcaggaaacacaacgccacagccaaaactgtgaataaatctgggaacgcaggcgcaccaactcataatgttcgtatgagtgagatcggttctggcgcactttcccaaattatggcagaatcgcaatctatgatggttgaggaattgcgttggcctcagctgattgccacagtggagactatgaaatgtgattccacagttgctactgccttagatacaaaatatgttttcatcacgaaagcattcaatgattttaagatcctttataatgttaaaagtgaagactctaagaaagctgccgagcttatagagtattctttgcgtaatttggcaaaccaacaaactcttcgagatattgcaagaagcgcagctacctttaacgagtatggtttttcactgtttgagaaagtataccgcagagagaaagaaggtaaatatgccgggatgcttcttatcgataaaattgcattccgacctcaggccagcctgtccagatcagagccgtttgtttttgataagaatagcagaacactgacaggtatttatcagtcacctaatgcatttctaaacactcagaatgcacgctgggctggacctcttgctgcaatgccttcaaaaggctttaatgagcctgaaattttcatccctgctaaaaagcttatgctcatgaccctgtcaggaacagaatctaaccctgcaggtgtgtcacctatgataggttgctacagatctttccgtgagaaagttctgattgaaaaccttgaggttgttggctgttccaaagaccttggtggtgtgcttgagctgaaaattccttccaatattttgaacaaggccagcattgacccgaattcaatggaagggagaatggttgcagaccttatgcttgacgcagcaaacgcccatagtggtgagcaaagtttctttatacttccgtctgatagagataagtctggtaaagagctttactccatgaccctgaagggggttgacggtatgggtaagcagtattccactaaagatttgattgatgcccgtaagaaggcgattcttgaccgtttcggtgctggctttattaacctcggtaacgataacgttggatccttctctctgtctgagtcaaaacagtctatccatggtcattttgttcagcgtgatatagatattatcactgaagccttcaataaggatcttattccacagcttctggcattgaatggtatcatccttgaagatgatgatatgcctaaactgaaacctggtctgattgaagaagtggatatggagagcttctccaagtttgtccagaggatcggtgctgtaggttacttgccaaaaactcctgcagtaattaataagattcttgaagtaggcgggtttgatgaaagatttgacgaggacatggatcaggaagagctgatgaagctcttgggccaggacatcagtagagctggtgatggaatggctgcaggatccactggcaacggcacttctaagatatcatcaaccagagataattccatatccaacatggaaaattaaaaattatcaacacagggggttgcaaaacctcctttggcgtgataaaataatccacatggggaataagatgccacaggaagaaatgatttcctacgaaatcatctacgagcctgacactaaagatgctcacggtgagtggatgagtaaagacaccatcaaaaaggctaaagataactgggacgcagcatacgctgcaggcctagtttctgaaaaccttttccacttgacctctacagatgctttcactattgaaaagacgtggattcaagaagagtttgatgttgtagtaattggcactgagcaggtcatcaaggctggctcttgggttgctaaagttaaatacaataatcctgaattatgggaagctaagaaggctggcattgttggtggcctaagcattcaggcaacaggtaatgttgatgaagaaactggtgaaattaccaacgtaaacttcgggatcagtgttgtagaagagggcaatgaataatgtctgaaaaaacgattactattaaagagaaggggattgccctgtgccataaggcgcaaggctatagcgctaacaacagacctgtatctcttttgatgaagagtgatcttaagcctgagcagttaacagacgatattgttaaggcacttcgccaagttactgtggagcttagttttgaagaatacctgcgtcgtttcttcgatatgtggtatgatgatgctaaagcacttgcacacatgcttggttttgagattgaagaggaggcttgggctaaagagcatcctgattgggaatgggcgcaagctgacgcagagtcttgtattgcatggctggaagagcgttgtgataacgtgaccattcataaggctgcaaaagaaggcaagcagcttagtgtggtagatcagtacagcctgttaaaaacacaacagatttttgaacaagtaaccgctgatctcttcgataaagaagggaacctgatcaaggcggtacaggaacctgctgaggtggataaaactaccgaggtggatgatgttgcaaaatccgcaaataccgaggagaatccggtggacgtaaccaaaactaaagagtatctggatctgctgaagcaagtagaagagctgaaagcaacccagagtaaagctgaagaaattatcaaggcccaggttgaagttgaaaaagctaaaatgctgactaaggctcaagctttaagctttgttggtgaagaagatcacgcaaccctggttgacttcatgctggaaaaagctaacgaacctatcgtagctatgctggagaaagctcaagcaaaaattgaagagctggaagcagaggtgcataaaactaaagaagagtttgccaccactgaacatggtaatgatggcgaacctgttgtggatgatattgcaaaatccgcagaagaaattcttgctgaaaacgttgcaaaagcacttgctcgtgcacgtgcagaatctaataaataagacattaacgggggaaataaatgattaccgctcaatattctgatatcgtgctcggcaaagttgattctagcgatgctggctacaattttaaagagatggaaattacactgacagagcaccatcatgctggtactgttgtaacaaaaactggcactatcgctaacgatgatggctcagacgtttatggcgttctcgtagaccgagctctggtaaaagatgcaggaaaagttcatctcgctgagcctctgcaaacaggtcataaatataaactggttgttgcagttcacggtgttacctttgcaaaagataagctgctggggtctaacggtgaagcagctaagcaggctgttcttgaaaagctggaagctctgggtaacaaagttcacgtccagactcttggtgaagagtaagccctaaattgttcgggaaaatatttaagttttactttggagaaataaatgattactcgtaaagatgaatttggcattgttgatttaggtgctactctggaccttgttccgcgtcaattccgcctgattactggtatggatctgttcgaaacccgtctcggcacctcaacaattgcccagattgagcgtgttgatgaagttgtaaccgacattccggcacgccgtcgtggcggtgagcgtaactacgttggtagtgaacgtgctcaggttaaaaacctgaacatcccgttcttccctctggacaaaggcatcaccgcagcagatgttcagaacttccgtcgttacttcacccctgatgctccgaaaactgttcaggatgtagtaacccgcgttgttcgccgtatccgtgtttctcatgaagcactgcgtgagaaggcgctgttccaggctattctgggtaaatcctatgcacctggcgacacaacctgtcagtatgactactacactctgtggggtgtttctcagaagtctgttgagattgaccctgcaaaagcagatcaggatccgatggaggttctggaagaagctcgtctgcacatcgcgctgcaagctggcgataacgcagctggctatcgtattgtagccctgtgctcaccagagttcttcagtgctattacccatcatcctctggtagaactggcatacacctattacggctctgctcaggaacctctgcgtcgccgtctgggtgctggcggtcaagacagcgtataccgtgtgtttgagcataaaggtatcacctttatcgaagatatctctggcaatattcctaagaaagaggctcgcatcctgccgatgggtattgatcagatgttccagctgcactttgctccggcagacgatgttaacgaagcaaacactccagcacaggaactgtacatgtggtacaaacactctgcatacctgcgtgaagagaagattgaatctgaaacttctatgctggcagttaacacccgcccagagctggttgttaaagtaactctgaaaaacggtggctaatcactaaggtgattcatcccatatggggagggggttctcccctcccctttttatttattagggtttaacaggagtgtcccgtgaagagagccgtatatccagttgagtatgatcctctattaagagttttcaacaatcagttaagtttttatcaatttttagcacaatataacccagaaatcaatgttggtttatcagccctgctgccaccaacagaattcgttatcggcagtgttcactatccatgtagaacgattgtagacttcttcgagaagattgcaaaacacacaggcctgccaattgatactggtatttcaactatccgtatgggtgttattcttctgttcttcacagagaaccttgatgaaagcactttaacactgcaaagcggggatgtcaatatcacactcactccgtcagtgtttaaagaggtagatgctgctttccaagtttccgtggcagagggccatttatgggaccctgtagggatgcctaaaaaagtgaccataaacgatgagcaatgcaacattgtttatgaagaagatacccaaactttcaccattgagtggcctaagaaacgttctcaggttgtaaatcttggactggtctctacgatagctccaccgcctgaaccagagccggagccgcctgtaggtcctactgaacctggtggtgacggtgaagttactgtagcagatccgcaagatgtgactgtatcctcttcctcatttgtagccattgagaataaggatgaaatccttaaacaggccgcagctcttaacaacgaagatgacaaaagtggttcaaaagatgcactccaaaccttcgctaaagagtacggtgttaccttaagtaaggcaaaaactttccaaaatatgatgaaagattttgaggctgcactggcataattttgttaaggccccttccaaatcaggaatggggctttatttttacgaggtattttcaaatggcatggtatgaagatgaagagattatcccgtcaccgcctaaccatgatggtgtagtcgataccccagaagaaccaccaaaagaagatcctgttcctccggaacctgatccagaccaacctcttattgatattatgaggttattgcttggcaatgttgatgaggaaacactccctgatgaggtaattaaaacattccttgacatggagaagctgaaactaaattatccggcagatcctgataagctgcccctgcttaagtacaatgtgcttgtgcagcttgtgcggtggctgatgatgcaggaagtgtccagtggtaatgcaagtataacttcccgtctggaaaaaataggtgatgagaccatagagattcgtggtggatctgcctacgcccaatggaaggatttccttgattggctgctggcacacccagactatgtagattctgagctagatgcttacagcagaatgattatcattggtggtgttcgtgtagacgaaggaattcgggttaaatttaatgaaaacagcaacggaccgttcgatgtccaggggattacacctatcagtggtctaaataaccaacctcctcgacacccaagacgcaaacgcagtttttaaaaattgttgcttttgatgtatctttgtggtaaaatacattagtgagggatataatgctaaaggttaaatgtcaaacaaggttcaacctaaagcgtttagatcgcttctacaaagaacttgtgagacttgaaagtaaaacaataacctacggcttttatgacgaacctcacccgtcaggcttaaatatggcaacattggcagccattcacaacttcggttggaacgggctgcctgttcgcaatttcatggagacagcctttgcatttcacagcactcaactacagaccttgacagaaaaattgttgagagctatggctagaggatcaaatgcagaggctattcttaagcagatgggggacacaggggccaaagctatccagtttgttattgaggctgggcagtttagtaatcctactgttagcgagcagtgggcacaagagaaaggcttcaacgaggctatgcggcattacgatgtgctgcttgaatctgcaacctttaaaatcggacagtaaaaataagggggttgagtggcagcaggttataagctgataggaaagaacagactaatacctcgtaaaacattcaaaggtcgccacagagtgtataacaaaacagttggtggcccttttgccaacgaggggttagaacttgagtatgaagagtttgatgtcttagagtgtgttgtgcagccgttgacaggaagggcagctaaagattactcctctcaaataaaccccgaaggtgacagacagtacgaggcttttacagtttactcctcaaccaagttgtatagtccggacgaaggaacatatgcaatggctgaccaaattcagctgcctgacattcgtggtgacttgaaatggtttaccgttttaaaatgcgatgcatatgttacctctggtggtggaagatatagattttttgtggtagaagagcctgaaggagaaaactaatggaagctttcgaaaaagttttttctgatcttgaaacaaccattgctaagcttgtcaaggttgccacaggaagaactgtagttctggcagaaagctctaccataccaaagccggaaggtgagtttgtactcttacaaaccttggcgatcaatcccaccacttgggaagataatgagtttcaagatgcggagggtaatgcttacgtaacacacagttacactgttacctatctgttaacagcttatcgtggtagagcgcatgctgcacttagcagagtattgcaagcaataaatcttccaatgttttatgacaagtatttccctctgggatcgtgctttgcctactctaacaattcaacaatctcacctcaaagagtgccgttgaataagcagacgtatgaaaatagagccactgtgatgctgacatttaacgtaaggtttgttgaaacagacattggggcttttgaggatcttcagggaattaaggctgaaataaccacacacttcccttcacccaattctggtaaagcggttacagacagtggtcagtaatcgttataattgtgtagtgtaatgattacactgcgtgtttgatatccgtgcacagatattaagaggaaacaaatgccatatttagataaagtggtagatgttacagttaacctcggaacccagcctattgacactgtaggtttcgaaactccgctgttcatcgctatccacaacaactttactgagcgagctcgcgtatatgcggagctggatcagatggtggaagatggtttcgcacaaggatctgcagcgtatgagtttgcagcaaaagcttttggtggtgtattccctccacaatacgttatgatcggcagacaggccaaagaaaagaccactgtagattttaaaggtattgctgccgcagccgataccgatgtcgtaatgactattgcaaaaggtagctacaatacttctttgacagtacctatctctggtggaacaggtgcaactcagattgcagagtcaatgaagactaaaatcgaagcagatgataacttggacgatatcactgtagaggctgctgatggtgttatcaccatcactggtgactgtactgttggttaccatactggtaactatacaatcaaaaatatcgccaatgctgaaaaaccttctacagtagttgataagatcaatgctgagcgtgacaattggtacttcctgtgccatgaagaccacaccgacattgaagcatgtgctaagtgggctcaggctaactacaagctgcatgtctactctactgcagaagatgtgactggtaaagataataacatcgccaccaaactgaaagctgcacaatatgacagtgtcggcatgtacgatcctcgtgcagataaggacttcccagagggtggtatcataggtgctatggcatccaacgatccgtcttacggcgacagcttgcacttaaaacagatgccaggtgtgattgcaccgtctctgactttaactcagcgtatggctatttgggaaaaccacgttaacttctacagaatgattaacggtgttggcgctttctgggaaggtaagtgtgcttcaggtcagtatgcagacgctattcgttttgcacactggatcaagttcagatctgaagaatctatgtttgggtacatgcatcgtcgctccaacatgggtttaagcatgaagatgtctgatgatgatcttccggttatcaagtctgttctgatgaacaacccgatcaatactggcattaagaatggtgcgatcctgacaggttttgacgaagacaataatgtattctacgacccgatcatcacagttcctaaacgtgcagaaatcccaaccaatcagttggctgctcgtgttctggaaggtgtgaaagtggaactggtgtataacaacgccctgcacttcgttcgtatccggatcaacgtccttctggacaaagttggttctaaatccaccaatgctgttgcaatgactgaataaggaagactagatggaaactcaaattttaactccttatgcgtatgaccctaaaaaggtcaaactgtacctgatgcagcagcgtgtcactggcttcgctgctgacaccaagatcgttgtttcaagaaacgaagacaacatctaccctcacgttggtgtggatggcgaaatgtctgcggccctgtctcgtaaccaatctggtgttatgactgtatctttgcagaacacttctgtatggaacgcttacctttctgactggcagaaacaggcatcgattactggtctggtattcttcccagttctgctggaaggtagccagggtcctggtatttccacaattggttggatccagaaacagcctgacctgacttacggaaccgaagtaggtcaactggactgggatatcggtattctggatgcatggctcaaccgtgataacatcactggtgctcttactggcctcgcaggtcttgcaggtattatctaagggcacactttagcataagcctcaccttcgggtggggctttttgcttttatggttttgacacacgttcttgaattgcttgaaaggttaaattgacaatgcaccataatcatggtaaaatacacaaatatggtgcacaacatgactaataaggatgctataaaatggctataaactttagacctacaacagagattgatttagcagggcacaactttgtgatcacccactgggggccgatgaaagcaatgaaaaacatgcctaaaatcggtaagattgtggctgtcccgctaggtgctatcggtggatctattctctcaggtggtcagaatatggcagaggtccttcctacagccctggcttacctgttccaagaacttgatgataactccattgaagagctatttaaaatcttgttcgaagatattaccgtagatggtgtggataggcttaacccggatgttgtgtttgcagggcatctgctggagatgattaagctggcaggtaaggttctggaggttaactacggctgttttttcacacaagacggtttaggaagccttctggagatgttacagcagatgggtatgattcagcaggtgaacaatctggatcagactccggaagagcaggaataagcaaggttgttgtgagggccagtgagtgggcagccaagaacagttcactcaattggttcgactttctttggtgcagggtgctcaagaatttcaaaggggaaaattttgaatcgctaaatcttgcagatatggcgtatttcctgaagctctgtgagtatcttgatatcgaagaattcctagataccgtccaaaacagggaaatggagcgggagcagaaggctgccgcagctgctgcgaaagctaagcgcaggagaggataatctaagggccggattccttttctgggatctggccctttttattatgaggaaaccatggctacaaacaaaatagttgccacaacagtcaacaagattggctttgagatagagaactcctcctacaaaaaagctgtagagaaaattcgcagtattgggagggagttcaggaaactgggcgaggattttaactcagccaacccaatgagtagatggcaggcggtagctgttaaaacccagcagacaatgcagagggttgccagacagcaatctcaggcaaatgctaaactgcacagagagagcgtagcacaggccaagaaagaggctgcagtaagggctgcaatagaacgtagggagaatgcgagacgtaaacaagctgtaggtaatcttaccgctaaaaatccagaaatggctaggatgcgtaagttctaccagcagcaagctaaagaggccaaaaaggctgccaaatctgcaccagtgtcttacggtggttataaggcacctaaggcaagagttttggctaatgccaaatctttcaaatatatccccggtaaccctaatatgggtggtgtggcttccgaccctaaccttgtgaaagctcagacagccgctatgaatcgttatcatagacagctaagaagagacagtaaagctggtatggataataggcttatgtcggatcgtgaggcaagaagaacccacctctacaactccgcgataagactttctgccaagtatggggccggattccgtggaagcttgccaggatactcagagttagagtctaggtttgctcgcggggagatgaaaaagtcaacctttaacgcccacctgtcagcgctgcagtctgggtttaaaagcgccaccagccaaacgcttacactaggcgatgccatgagagacttacgtagatctgttattaatgcaacagctgcgtatacagctttttctggatttgctgcggttaacagatccggtcacatgatggagggggcaagtgctgctcttactgctgttactggagatccaaacaaagccaacagtgaggttgcgtttgtccagcaagaggctatgcgtcttggttttgatctcaaatctggtcttcaaggttacgcccagatgtcggtaaacgccaaaaaccagatgacaaatcaggaagtgcatgagctgttttctgcatactcccagtatgctgctgcttatggtgctgatgaggtaaaataccagcgcggtattatggcaatccaacagatgctcggtaaagggcaagtaatgtccgaagaactgaagcaacaacttgctgaagcattacctggtgcatacgaaccttttatcaaggctaccaaagaggcttttggtctttctgaactctccatggatcagttcatggacatgatgaagaaaggtgaggttaaaacagccaagatcatgaagtatgtggctaagtacatgaacgaggcatctgcagctggttatgaaagaatgcagaagtctaacgtgctggcagaaaacagactgaaaaccttcatcgaactgactcgtcagaaactgttcacccgttggtctgacgaactaacagagttctattatacactgatccgcactggtgagactctgcaatttgtgtgggatgcatctggtgattttgttagcgggtttgtgagaggtcttaactgggtagttggtgaactaaacaacactatagtcaagatccgtatgtttttccttgaatggggaatcaaatggggattcataacagctaagacgaaggaatattctgaagagcttcatgacacctttagctatgctaaatgggcagggtttgctgctgccatcatgctggtagtgaacgccctaacaaaaggttttgtcatggcatccatgcttgtaaaaacctttaaattccttagctctctaaggggggcggctggagtagcaggtgcagctactacagaaggatctggtggtggtggcgctccggcaggaaaagggggaggtggcctcaagacacctggtggcaaagttggtctgctcggtaagctgggcattatcggtacaatactgagtgccggggaattatttaatgaccgtttcaacccactaagtgaaagaaatcagcagttggatactatcagcgatatgattcgcaaagatatcatatcgggtggtaacgggtttgtcaatcctttggacaccttaccgggcgggactcttccgttgccaggtggtcctggttttgcttctcaattaagaactatggaaatgctacctttagagatcagtgatgggaaaatcacgatttcaatagatgagggtgagtttaacaaaatatttgatgcaaaacttgagtgggagaacaataaagatatcaacttcatgtctaccgacctttggtaataaactgtgcagggggctccggccccctttattttatcggtgttgtaaaaacggctattttatgatacaatatctagatggtatcggagtgtcctggagaggttatgccaagcaatatagttgatgaaaaagacctgtacaagcctcaagaggttaaatctccaaaggctgaaaaggcagagcagcaaactgaaagcgatgtaaagtacactatgtttgtcagcggtcttaactatggtggtcgcaatacggagatgaagggtaaaaactttactaacgatcttgccattatcttcgatcaggttgagaattactctttcaaacattctgttgataagactgggtttgcggtggaagataaatctaccctgtcagaccacgctgtaattaaagatggtgtgttttcttttactggtagggtaaatacgtccccacacataatctatgagcaaaactacatcgacaggaatactgactctaaaaaccctgcagcatctatgcgaccaggcgctgcattggaggctttgactgagattatcaataaacgacagttggtttctttggttaccgaggagagacttcttgagaactacatcataaccagtctttctgccaacaagtctgttggtgaaggcgctgcaatggtgtttgatgtagaacttacagagttccgcacattctacttgaataaggttgttaatgcaactgtatacagcaatcctaagaaagtaggcaagacccaacaaaaaggtgctgtcaacgactgtaagaatggtagtaacgtaggtaacaagagggacacaggagcattcgcagacactgcatccacaaacgctgcagaggagtggcagccatacaaatctatgatgtggacagatgaaaacggtgttacccaatcggctgcggattggtattatcaggaatatggaagaccttctaccatagtcccatctgagcaggggaactacaacaaagttaacgggaaataaggggagcgtataatggagcttaaagattggtgcataatcacctttgtgtgggacattgacggctttcctgatcaaaccatgcgtgttgttttagacaatgaaacgtatgaaatgcgtatgcaatggaatgagagggatgagtcctggtggttatctcttggtccagtgggtgacagccctttagtaaccagaaaagtaacagcttgtcaagatattttagacggactgcattacagagatgatttaccgaaaggtagactgatggcgctgtcgtttaaagacgatcaatattggggcagggtgggaagatataaccttggggcgagatctgagctacaacttgtatacggcaccccggttgatctttacaaggaacagcaagggttagaataatggcagagtacagacgtagaacatggcgattattgtttggtcgtcctgtagaacatggcggtaaatcaaaaaccaatatcccaaaatctgttgaaaagaaaggggagagtgattccggagtttatgaagttagctcggacactggtgctgccaatatagagtttgacatacaaaaggacaataccaaagagccaaacaaaggttatgtgacagtttacaacctgtctgacgatacagttaactatctggatatgcatcaggctgatgcccttgcagttatgtttgaagctggctatgataatgagaaccagttgatattctccggaactgtggagtttgttgaagacaggtgggaaggtccgaccagaaaaactaagttcatctttggggatggcactgagaacatcattaagtgccaaagcacaagatcttatcagaaaggcacacctctgaactctgtgcttaatgacctactgaaggatatgaacttgccaaaaggtagggttgttggttttggaaaccagactttgcaatactctatggctttctctggaaacactgcagagaacctccgcaggtttgcaaggctgaccaactccacatttagcgttcaggatggggctttgtattggaccaaggttggaaaaaggttcaaagactccgtgtttgaaataagtgcagagtctgggatgcacggatctcctacccctaaaaacccagaacctgctaaaaaacgaaaagctaaagctgctgccaaaggtggttcgacatctaaaaagaaaaagaaaaacccgagagaggatgttggccttactgtaaccacatgccttaacggagctatcctcccagagtccactatttatcttaaaagcaagcaatatacaggattctataaggtgatcacggtgcatcataagggcaccatagaaggaggtgattacactacagagcttggccttggggaaacagtgggtggagttgttgacaaaactgaggaggtataatggcaataaataggaaagatgctgctgtaagatcctttatagaaaaaataatgagggactaccacaccagtatcagggccagagttgtcagtgttgactacagtataccttctgcagccgtgcagccaatagctgaaactacgtttgatgacggagatgtggagagataccctcttatctatgacgttccaattcaggtgatgtctgcaaacagcggaaaggcaaggttaacacttcctattaaggctggagatgttgtaggattacagttttcagagagaaatgaaaacaataacgacgatcaacaaactcacggcctgtttccagggtgggcaatcacctctgtccattcagactcaaacgctttacagatcgatcctgataacgtagagttatggaatgatagggtttattttaaactgacaccttctggcgattttgagcttcaaacacctggtgggacattacggtgcgacagcagcggggagttttctttcactaacggggctgccaatttgcgagctgctgtggatgggaatatcagaatgaatggtgccacaatagacccatctggtagaattataactgctgctggtgtggatttggattcattctatgcagaatataaaggtcatacccactcttgccctgatggcgagacaagtggaccgcactaatagagggctttcatggctacgctttacagtgatatattgatggacccacagacaggtgatttggcgatagacaaaggtcttgagttgatagattcaaaccaggtaagtctgcgccagcgcttgtggatgaggtttaatacgtggaaggggagctggtactttgacgagttgtttggcttcccttatatggactttctcagtaagaaggtcatgaagactgttcttgataacaagattatggaagtggcaagacaagagccggatgtgctaaacatcataaacttccagtctaccatggatcgaagatcgagaacataccaagcgttctttgaggttgttaccaaagagaacgagattgtaaggctggctttcgtaggtcttgatcagttcacctacccacagcctgattctgggacaacctctctctgtgatgatgagggttggattaagtgggctaataaactgtactatctgatcaacttcaggttgcctagaaccggagatgccacatggtggaaccagtatgctggtcctgagatggaaaacccgatccctgtaggctctctgttgactcaggataaagatctgctgatgactgaggcagaacaaaccattaaccgcaatacctggacgcttgctccagatgagcgcgaatactctggtgttattgctacctccaatgacgaggctattgccaaccagtctggtcgtgctattgatgttaactaaggagaaatcatggctgtagcttatcctacaataccaattccagatcttgaagatgcagaaacagtcctgagtgatgacttcttggttgtcaaccagactgatgggacaagaaaggctaagattgacgatgttgtcaacgatcttagcattactaagatagtctatttcacagagggtggttatcttaagagcaagaaggactttgcttatgatccagaaactaagcgctactacacgtggaacggggattatcctaaaataatcctcccagactccacggtagagggtgctgggggtgtgtctgcaaatgcctggtctgtttttggtgagcttgctgcaacttcttctggcagaatagttgattacggatctatcggtggtcagcttgatatggatcttgaagttgcggatacctttaaagttcgactaacttcaaataccacaatctcttttgaaaatcaaacagaaggtcttgaaggggtggcgagaactataaccgtatgcattactcagacctctggcggcaacaaagtctattggcctggtaatgttaaatggtcctacggaagagatcctatcctaacatttacagctggtgcaacagacattttcaagttggaaacctacgacaacgggttaacttggtacggggcactgattatcgcaggagctatctaagatgcgtattcaacataacattgataacgtatttcagatgattgaggggcacaggaagtgcctcgataacaacacaggtattaccaacacccctacacaaaataagctagtaaaccctgatggtcttatagctgcagggtgggcaggtaataagataaataatgattgggcaatgcatgagtcccaagctgtgttgattctgggatacattgaagcatacagagcatcgaaaagcgatttctatctggatagggcaaaagatgcttgggaagcttacaatagtcatcttctgggtgcatatgcagtagaaagtaaaatgcaaagattgtcccactaccctctatccacagatggggttccatcacatggtgggtttaaagatgtggtggtgtcttttaccaatggtagaggaaaaatcccagctggatctccgacatggggggaatacctggacaaggcattccaagcgtataacggcgtgttaggaagaaacactgtagactctgatgtttacggcggcacagatgctaacccagattggacaacatccggattaagttggtgggttgagtggtatatagcatgggatggtaatcgctattgggctaacggtagtatagctgatagtggtcatacgtctgtagagtttggcacaatccaattacaagataagggtgttacaggcaaccacaaagtgacctattgtgtaagattacctcaagagcagggtggatcggtgatacctgcaggatcccctgtaattgtaaatcccataaacgtggttgcagataatcaggacccagagttggacggggaagaaatgtggtgtgacgcttgttatcaactctacaccttgacaggtgaggaaaagtattacaccgcgtttgaacagtcttacaacaagttgcttaatttcagtgatataaacgcctacgacaaactgtttaggaagaccacgttgattaaggcaccgtttacagatggtacttgtcttgttgcaggaacagttcctgtcatgagcagggacagtgacggatatatcaattttagaatgaacgcacgccagccttgcgaaataattcaaaaagggactacatacaaaataggcagagatgctgaaattgttatgaatttcggaggagaaggggttctgttccagccacatttcatccttaatgatggcaacaataacaaaaaacagtacaggataggtgttccttttggaggggcagaggtaacagaaatagttgccaaggttactgatttcgtagaggtggttggtaaagacggtaatccatatctcttacctaaagaggaaaacattgtcgtaagtggtggcgctagtgttagtatgcagtatgataccgacatttacaaccactctgacaacttcacccgttgtaatatagcaagaggtaaagtaactttcaattttggaagagagatttctttaaactcagtaacttatcgatcagatgatgagatggtaagggtcaaatttcttgacaaagacaggtggttatggtatgctgatctatatgccactaatggacaatggataacagaaactcttactctaggagatttcaaactagatccgacacaacctcatcacactgaagaagagattaaacctttctttgctaatcctaaggggctcacctctgtagatttcagcctaagcgacaggcagataggtaatggcttgtttgatctatattgcgtcaacacgctgccgcaattctatattgcagatagggatgcttatctaatctggtttagcgtatggatggcaagcaagacagaatcaaccgctaaggttggcgattgctatgtcagaaactacaagcaaggtgcatacaggcacacaccaggtgtgttccctgccggaaaggtgatagataaggaaaactatctcttagaggaaaggccaaattggccctacccaggcatgcaatacccggcagtctactgcatgggtgcagaaaacatagatcgccatagattgtcaaatacaataggctttctgtatgacgctcaagtctggtataataatacatttaagacagagggtccagttgcctcacgttatgtatggcaaagaggtaatgaagggttgactggttggtgggagatggtagataactccaagctccagtcaagatcttttgttgctgcgtgccgcacaatctatgagctcaagaaacataaagaacctgttgatgaaagattattcctgttctgccagaaatgggcatggttcctcaacagattccagtcatctcattcaggaaatctgcctacagactttaacacctctgggggatattcttatcaagacagaggggacaggatgtgggtggtaggtgaatggcttgcaggttgctgctggctaggtctgtgcgggtattcagagacaatacctcaaatagatattgttgtagaagcctgtatgaagctactgcaaaagcaccacttcatcaatggtgataatgttttaaacggctgctgggcagtttctgacccggtgggctatcactctggcgaaatccttcgcggtctgggcctctatgctcaataccgtggattgtacctttaacatagggggctgtttgccccctttcaggagaaagaatggctgatattaaagttgtcagaattgaatctcttcctgccactaccgcagtgacagaggatgattacctggttgttcaacaaccagacctgacccgtcgtgtaaaaattggcgatgttgtccatgttgatgggactgtttctcatgtaatctcctttaaggaaggtggtaagttaaacggcccaatggattttgcctacttcgaagaggaagacctctacctgcgttggaaaggcgaatttccgcacactgttcctgcattgtcttcaccgtactccgatggtgggattactgacgctgcatggacggtatatacagacccgtccttaagggaggagctggaatctaccattggcgcatctatgatcatgacagccgaagggcagtctgtccaggatgtaatggatgttactgttcagacagctaacgatgccaaagcacttgcacagcgtgtagattttggtacagtgcacactgtaggcgatgttattcaccttgataactttgttggccctgcagttattgaagagggaagaactaccaactacccttctgcagcagctggtgaaaaatttctgaacggtgtggtatctcgtcgtgatactacaactgttgatggtattttccgtggcgctaccaccggagccatgtacaccattgcagtaaccaacggtgtagcaacaacgaaaagaatagcacttcgtgatgaatttaaacgcctggaggcaaacaacccaacaagaacagttatccgtgctggagatgatttaaacacggcagggtacttgcagcttgacgcaacaggccgttggggtatgtggaaccaacaaacagcctcgtggcaacctcttgctatagagcaaggcggcacaggggctagagatgccgctggagtccgtatcaatatcggtgctttctataagcaacgtgcagcccttgagccaaatttcaatatcaataacttgactggtaatcaggatggtgtatactaccagccgatgactgcttatgcaactgaggcaaatggttaccctgcaggttctggtgctggtcacctgattgtttggcagaacaatgctaacggcggtacaggttgtcgtcaggaatactatccattctctaacgtagatgtttggtatttaagaacctatcaggccaacacaaatcagtggactgcatggcagccgatggtcagacctcgtaacgatgatacctttagagcgcacatcggtctcgggtctagaaactcccctacctttgggcacctttacctgtctcaaagttctgctgatgttaagtcagcatcaggtattgttaacggggacaaatacagcgctgacggtgtccttgagcatggatataggatctactctgaggtaagaaacgacaataaggcttggttgacaatccacctgcacaaaggtgcaaaaggatctgaaactcatagatatttaggtttccgcgaagatggcgtgttagactgccctaaatacatgcaggttggggatcttactggtcagctgacaaactggggtcttggagaatggatccgtagttcaggggcagaaagaggcttctgggggtccaagaaagccgccaagatggttgtctgggatggtgggatggacgaatccggtaacggcactctggaatggggtgtttataacaaccggaaggccaagtgggaacctttacctcaagccgcaggtggtactggggctacaactttagcagatgctcagaatctgttcaaagttcctatagcagcaggtgtgaaagacttcttaacactgccaagaaccgcagggatggaagatgggaaatactacccgatcatcgttagaacagatccgtattacgccccttcgacaggtacagatattaccatagtcaccaggtcttcatctggaaatgaccctatgaactgtgccaccctgcagtgtcactatagaactggcggctggacggacaggggagactctttctacggggtagtaaatttctaccagaatgaaaaagcacttcttgggatggttgctccaacaaggggtaaacaagagtatgttgctttctatgcagaggctcgtgctttccctgtcagcatatacgcaagtagaaatgttgtcgaagtgtttaccagagagcaagattaccaggttggggctgtaacagacaatcaggatggggttaagttcgttgcacctcttcagtcagcagatttgaatctcgctattcttggagataacaacaccaataccagacctattgttgacttcaaaggtacttcagggttctacactggtggcggcacacagtggcactatataggcactgctgaacgctatgctgtgatgagcaaaatgaatatgcctaaagtcgagctatgggcagacggtattgactacctttgccctggtagtcagaccactcgaaaagcactgttctctaatgcagggttccaggctgcgtcggaaggaacagaggatctgatcaacaacacctttacctctaaatgtggtaatggtgcaagactgcaaggacaggcagagttcagatctactccagaagctgctcaagttattgttcgtgatgttgtaggcacagctcatagattctacaacttcaacaaagatggcactttctcagctccgggcggttttgtatgccacacgggtgcagactggaacaaccagtttgggcctaacaacccgtcaaaaataatagctggtaatgttaacggcccacaagataccatggttgtaggcgggttatctgtaggattctcgggaaactacgctttccagattgctggcagacaaagtaacttatacaccaggtctatagaaggtggtaatcaccatccctggaataaggctatgcaacacaggggtcaaggtcttggttcttcagaccttaacacctatcacggattgtgggaaggtatttaccatcagcctgcaaataatgatgcaacatatgatcgtcattatcccgtaaatgaggccggaacacttattgtgttgcaaaataacgccaataacggtaatgggtgtgttcaagaatatattacctaccatggcgatagatttacacgttatgggaatatggtgaaacaggtcttcacttggggcccgtggacccaaacaggtggtaatggtgttagcttcaggtatggaggaacaaccccggaaggggaaataccaaccccagagttaaaggtatatatttctggaagtcatgttactaataacggtggcaacatgcctgctaatgccgcccatatgtattattggggtaacggcagcacaggagatcgtccaaacgtgttagagtttaaggttcttgacgagtctcaatcaaattgggtatggcattgcggtaccttgccagataaatcaagatatctttctgtaaacggcgctgtgaattgcacatctgtcaatcagagttctgacagagatctgaaagataacatagctgttattcctgatgcgttagaagctatccggaagatgaagggttatacttacactcttaaagagaacggtatgccttatgcaggtgttatagcacaagaagtgcttgaagcgctgccggaagcagttagctctttcgtgcaaagaaaggaaatcccaaaccctgatcaagatggaactcctttgataacagaggaaagattctacagcgtggattacgcagctgtaacaggcttgcttgtccaggtttgcagggaacaggacgataaaataaccgaccttgaggagcaggttaaaaaattgacagaggttgttactgggttgcaagagaaactgaagtaactgttttgccctcgcttcggcgggggctttttgtttgtattgcgtattaacttaaaatctggtaaaataactatcatgattgtttaacctggaggcacaatgtttttatgggaaaggcctagataccttccagatattagattggagctgctggcagatattgttacgtttaaaagtccgtttacaggtaaaacgcaaaaagtaacctatgccacacctaactggaaaggcactttgacggtctccaatatcagcgagtcacagttgctagagcttaagagctttgttgatcaggtgtataaagatggaaacatctttcttattaaaacttacggtcactcggtaacagctaatgagccaatcgcccttgggcctactggtaacgacgattttttgaagacggtagggtgggagccaaacagagacatagccagagctggggataaaatatctgtcaatgatgaattgaaagtggtaacagctccagtgcgtagcgatggtgttgggtctgctgttataagcatatctccaagacttagaaaacctattgccgcaggggacactatgaagataataactcaatccccgaagggtaggtttcatatcagagatatttataaaattaagcaaaaagtcgatgctatgcaaaaaggtgataatatagttatcaacttctttgaggatttctaagatgatcagagcgccattagataatttatttcttgaaaagctggagcttgatggtgttgagatcttaattgctgcaaagctggagctaccgacaggaactgtcagggtgtgctcaggcactggtgttgtagtaattgaggggcaacattttatagggataggtggatcagcaacgttaactgctgtgtctgagaaagatgccaccaacttcggatctgtggtagcgacattgaacgggtttgatcctaagtatgtgggtgatcttctgaagacggagtattccggttgtcgtgccacgttgtacattaccgctatggagaatggtctgcctgtcacaactaatggcttgtttgacggccttataacagatatggctattcagacaggggagaatagtgctttgtccatatccatctcttccatcttcaatagttggttaagaggttttccttatcggtacacggaggaaagccacagctcaagaaacgataatgacagattttttaaatatgtggatcaggtggcgagccgcccgatcatttgggaggtttaatgagcacacaccctcgtttagtggattggcaagaaagattgtggaaagtgtttgacgaagaggccaccataccttttgaatggggattccacgattgttgcacctttgcggctaagtgtgttgatgcccaatacggaacagattttctttccaacttcgaaggaacgtataaaacagagttggaaagcaaaagatggtgcatgcttcgtttcaaaactacacacctgcctactatttttgatctctttatgactcggctggatactcctaaacaggttcagcgtggagatattgtcattttcgaaggtctgaacgggctcaccgctggtgtgttctggaacaaccagatttgggcgaaaggtgataaaggggtctttatgttcgacatgaaagattctatcgttgttgatgtctggaggtattaatgccaattgcaatgattgataacatcgttgcttctgcaagatcttcaagttatgactggaacgcatccaaggcagctctggctgacagcctgaacactgttaccaccagaactctggataagatttttgagggcaacaaatcttacagaagtcagcaagatagacaaaagcttctcagatcttctgctgcaccttgctctgtagtgtatggtaagacacgtacgtctggattgcttgcgtttttggagcaggacagagacagaactctccactgtgctattgttcttgccaaccaccctctggaagatatagaagatatacttatcgacggtaatcctatttcctcgtatggagatctggtatcgtgggagctacataacgacagaaaaacatctgatcctttcatgggtacacactgcccatcatggtcaccagacatgataggtagagggatcagttggctacgtgccagcttcaggtttgaccctaataagtttccttttgggttgccaaacgttacactcgttaaggttggtaaaaaatgctatgatcctcgtatcagtaaagaggtgtacaccaataacgcagccttggtgatcctggactatttaagaacgtaccttaaatgtcctgacgaaaccatcaactgggagtcctttaaggaggctgccaacatatgcgacgaggcggtaaaaaacgctgacggaaccagtgagcgacgttacaccattaacggtgagtttgacatggatgaggccccagcaagtattatggcagaaatgctgaaagcttgcggtgcagaccttagttatgttgctggtaagtatggtttgctggttggtgcatactatggtccggcaacaatgacattgagtgaggactgtgtctgtggtgaggttaagatctatccggaagcctcatttgacaaaagatctaacacaataactggcagattcactagtccgaccaaagggtattctgaaacagattttccatcagtgtttgtcccagagtggatagagaaggatggagaaagaaagataatcgatatagactatcgctttgttaccagcccttatcaagctcagcgtgtttctgcaatattcttaagacgtgccagagctggcaggattattgaagtcacctgcaatatgcgaggttttaaatttaagcctggtcgttacgtcacaatggaccttccaagcattggtatagtgggccaagaaatgagggttctcgaatgggagttcactaaaaagggtggtgtcaaggtaaaacttcgtcaagatgctaaagagtggaatgatgccaccgggcaacttccggattctggcgatgtagatattccgatatccccatccggtgtagctcaaccgcaaaacttcagatactccgtcctccaagctggggaaataactcacggtgttctggcttgggacaacgttgggacttacgctcaaaatattgtgcaggtaagaaagaacggagagattgtttggacagcacagacagttgagcagtttgtccgagtagaaggcttgaccaaagggtcatacacagcaaccgtggttgcaacatcttataaaggtggtgtatctccagaagcgtactgcgagtttaacattcaggcacctgaagctccggtttctgtagaggttaagcagggatactttgctatcaccttgattccgcatagtagggatttagcaagcgtaagcacccagtatgacttttggacatctggtatgacaaggttgccagacaccagtgatgcaaccgttacttcaaaagccacccgtatgggtgttggttcaacttggacatctgaaggtctccagaacgataaggtttattattggtatattcgaaccacaaacgcttttggtagctctcagtttgtagaatgcgctgcacgctgctacacctctattgaggatttgatgcctcagatagatgctgaattcaaaaagacagaaacttataaagagttgatgagcactttggattcctctattgaagaggttgaaaatcgtgtcacagaacttaacaggtacatggatggtagggtagatgaggcattccagcaacttggagacagaataggtgcggtagttacagagacaactcagaagtttgaggatgtcaatggcaatatcacagcgctggataggaaacttgttgctgcacagaacaagttcaccaacgatctgaacactgaaagtggaagattggcatctctgattgagacaaccaataaagcaactactgatcttctgaacaaaaagacagaggctttagatgagaaattggttgccgccaaaggtgaactggtagagcagatagagggagttgagagcgggtatttagccggagataaaactctagatggtaagatcaatactcagagaacagaacttgacgcaagcatcttgagcaccaaccaagccactgtggatcttttgaacaggacatctgaaactctggatcaaaagattagtcagacaaacgcgacggtatctaaaaactataccacccttgacggaaagataactaccgcaaaaactgacctcaacaccttgattgccaataccaacaaggccaccactgacctgctgaatcagaaaacatctgcactgtcagagcagataacttctgcacgtggggagatttctaccaacaagcaagcgattgatgctttggatggaaaactgacctccacaaaaacagcgctggatgctacaatttccgataccaaccaagccactgtggaccttatcaacggcacagcgtcagctattcgtcaagaacttgctgttgctaagcaggagatcatggatgatgttggggatgtgtctgagatcagggctgcagtagctacaacatctaaggctgtaaccgacttagagggtaaagtaaatgctcaatggggcacaaaaatacaggtagactccgcagggaataaatatgttgcaggtattcagttggggatggaagggtctggaggccaagttcaatcctacttcatggttagtgcaaacaattttgcggtatacaacccaggaaatggaacagcaacccttgctttcgcaatcaagaacaaccaagcgttcttgaaagacgcttttatagagaatggcacgatctcctctgccaagatcgcacaagaaatctcgtcaaacaactacgatggcaacgggtaccataaatacggttggtatattaacaagaacgggcacgcccaatttatggatgtgtgggtgaaaggcaacatcaacgctagttctggtaacttcacaggggcagttaacgccactagtggtaccttccgtggggatgtttatgccaataatggtagctttaggggcaccatagatgcaaccggaggtaccttccgtggtcgtgtagaagcttctgttatccgtgctaaccagttcgaaggtgcaattgttgcacacaggacttacggggattgtgctccagtatataactcccggcaaagggtttgccgttggaggtggagatacgtagataacgtttcaggtcagggtaagaacgtaacattcttctttaaactgaatggtactcttgccagctcccaactgaatgcatggatagctggtcatcagatccttgctggcaagaagtattttaacgacaacaacggcatgtgtgcggtagggataacaggtctgggtgaacaaactatagacattgttatcgagatttacacaccgtggtcaacgtcaagcgtgacaggtgtcacaatctcctgtcctactgtgatagtaagtcgttcaaactctagcttccagggaccttggaacgagtctcacgactaacctttaaagccccgcttcggcggggtttatttttatgctcagattgactattgttacaaaatttggtaaaataccttgtagagattttcataccggaggagtgacgtggctaagtatggattgacagaggctggtttcgttataccaaccctaaatgacctaatcgttgaaactaagcaaagcctgatccgtgcttttggcgaaaacttcaacgtacagagtaactccgttgcagataagctgaccactatcttcaacgagcgagagtatcaacttattcttatggcagcatctgtatacgcatcacagacgctgtatggggcagaaggtatttacctagatgaacttcttggaagacagggtatttaccgaagaggccgttctaaatcatcaggtacctgccagttgacgatcaacacaactgtgccgtacaatatgatttacgattccaaaacttatacgctggatagtggcaactttgttcttagcaatgatgtgcaagtggcagggaatcttattgctcacagaataaatgctccagacctaaggattggtaaatacaactttcaaattaccaaccagacagatggaagtatcaaaacaaaaagtctggttttaacagataaggctctggactcttctgatctgccaagcttttacggagagattaagcaattcattgtagataatacaactctgttaaacgacgatttgattcagatcgatatgttgacaggaacgttgtggataggatacaattcgaatcttgatcaagttggacttaatagtagggtagattttagagtatccccgattgtaggggaaagaactatcaccctagatgttatcgccaacgaggctggtgagctgtcaagagaggcagaaaccgtgacaacaatgtcacctactcccagtggatttatcaagcttaccaaccgagaaagattcaatgagggcagggatgttgagaaagactcagagtatcgcttaagagcttccagcacaaaacagttaacatctaaggctacccgtcctgcaatccttagcgctgtaagcgaggtgaaaggtgttgagaaagtgagagtgttctctaacaataccgataaaactgatgctaaaggtatacctccttacaagttccaagtggttgtgtttggtggtgcaacggaggacatttgccaagcgctttaccaaactatcgcctgtacgaacaggacttatggtaatattttctacgatgtcactacatctgacggtcaaactgaaagaatttattactccaaggcaaatacctaccgcctggatgtaagaattacctactctggtgctgcgctttccacaaccgaaaaagatgccattgtagaagctcttttgcaggttgttaacggactggatgttgcagatacgttgtacaatatccaattggttggtgctgcatccgctgctgtgtcaataggcagatttaatagactggtaattcaagttaaacctgtgggggcttctgatgaagcttacactacaaacgatattgttgcaaacatgaccgaggtgtttgacctcgatgaaagtaatataactttccaacaaactatttaaggcggcgagatatggcagagattaagtcggatgttaaccacatccacactctgccagattttgttcaggggggtcttgactaccttcctggagattttctggctgagaaggttaatttggtcacattcttaaccgtgtaccttaaaaggttggaggatgttgataagatgctggtaggtttggctgaaggaagattgcttaacaatgccagcggaagataccttgatgaagttggtaatcaacttggtattcttaggaatggactttcagatgctgattttcgtgccacactaattattcagcaggctgcagcatcaaggggcgggactcgcgaagatgtcatctccaccttgcgacaattgttcggaagagacaatttcgatacgtggaaaggagacaacttcaggtttgacataaatattagaaaaacttgctttgacatattgcagtccatcgatcagatcttagatatgctaccattaccttgtcatttgcgtcttacagaatcgcaagggcaagcttttggttttgaaggggactctacagctcttggcttcggatcagtgtgggaagaaaaccaattcggagttggtgggctggctactttgctatatgttcctgacgtaagacctgattgggacaccacaaccatttattgtgaaagtattacagtaaacgcaactagacaggagggttaatggcaacagctgtttttaaaccttaccgtgattactctacaatggctgcacagtttcattaccgaacagttcaggatactgccgttcctggtagggattataatcatgttgagggcgatgtaactatcccaattggggcaaccagtattgagatccccgtggaaattgttgacaaattacccaacaggttaccaagaagcttctttatggagttttcatcaaaatctcaaggagtgatgattgggacacaaagggcgaaatgtacaatagtttcagatgagaatcttgacaggatagcttgggatactgttgaggagagaatgtttcacccaagatattgggttacaaccactcagcagactgaaagtacctgtattgttgcagataataactgttgtattaaccgtttagtgtcaagaacatatggaggtatggccgggtgcatttgggaaacagttgataagtatgaccatttcggtattgggtttgatgatcactatgagatgagaaacaccaagctttggttcagaatgtcaataaccaatgccagcaacttctccacccctgaaaagatgattatgactgtagaccttgttgatggcacaatcatctatgttcctttagctcaatatgctgccagcatctcagaggataagaatgttgcagagattcatattgatttcgaggactgcgtcgggatggatcagaacaacaacatgatgggtgttgatcctcgccaggtgagaaggattttaataccgcttatgcctaaagattgggtaagtaatagcacagacccgagaacggaaaatgtagagtgtgagttgcgcctagatctgcttcagccagacacgggctggaaaatgatgcaacttaacaatattcaggttaaagagcacgacgttgggatctgcaccgcatatgacgatatgtggaacgtatctcctttaagggtgttgaacaatatcaagcgtctgggctataccggaaccataaaccattatgttggtatgagtcattattatgactacacatggtcaggaacccaatggtctataaacagaacaggagcgctaaacgctgcagcttataaatggcatgatgattttatgtacaatgccaaacgacataacttcgacgttatgcagtctgtaagttttgagctttacagcgatgcctgtccgttggaatggacccaaagagactggaacgataactacgctaaaacagggtatacaccttgtagctacctcctgtctccaaccattgaagagggtatgaatttccttactgcagtatttaagaattttgcatcagccgctatgagaaacaacctgccagtgattatgcaggttggtgaaccatggtggtggtacaataccgatactcgtagaccttgtatttatgattaccctacaaagcaggcgttttatgatgagacaggtgagtatgcattagatattgggactattgacgatcctaaaactggcggtgtttacgacaagtatgtagcattttgtcgtggtaagcttggcgctcgtattgcggctatttcaaaggcaataaaggcacacgctgcatcagctcagatgacagctctgctgtttttcccaaccattatggaaaccgagcttacgcaaaagctgaaccttgctgaccaatataaaaaagaagcaggtgctcttgatttcttctgcaccgagtgctacgattgggtaatgcaggggggtattgaaaaggcaaaagagtctgtaaacatacctatcgttaagttaggttggcaaccgtctgaaatacaataccttgcagggttcgttcctagtaaagagcttgctccggtatatggctacgacccaactaggaattaccaagaatttttatggagatgtatttgcggaaacatggcaactatagagtatagataccctgaggtaaaacagtatgtgtgggcatacccgcaagtaatgtctgacagcatcactgttaccgctagagattctaccgtgcttcatatggggcaggttgctctgaaagggtatgtagaggatgttgtcccgccagacttctcataatcaggagataaaatgtcaaaacctagttttccattagagatttgggcagaggaggatcaggttctgcctaacacccacagacagaacaggctacgcccgattgatgatttgtggagaaaaggttgggatcttggtcaaaagccctcatgtgaagaacttaactatattttcaatatgctcggaacttgggcaaaatacattgctgacgagcagatccccgctcaagaaggccgttatctggtacgtgataataacttgagtgatcttttgaacattcctgttgcccgtagaaaccttgggattattactaaggaagaggcagacgccaggtatgtaaaagttacaggtgatacaatgacaggcccattgggtttgcaacgtatcaactttaaagctgccgagacagataaggcttggatagagacaactattggcccagataagacaactctcgactttgggttaagtgataataccgggtcgtttgatgatggtggtacatctacagtagatgcgtttcgttggagattccagccaactcagccggatattaatccagagttcactttgatgtaccttaacgcgatcacggctaaccgtgcgctgttgaaagtggtcggcaatgttgaagttgtcgataacatgaggtgtaataaccttactatcagcaatacagcaacattcaccaactgtaatgtggctagtcagttgacgactgggtcagtgtatgttaatgggggtgcaagttgtgacagtatagttgtaagaagtcagcactgtgttgtcggtaacagaaatgtggtgcgctctgtgaatggagtgacggctaacggtaacggtgatgtaacaatcactatcccgcagacaggtgtgcaagacatcagaatcggtgcaagacttgttgacggcgtttctgaatctccaattcgcaacggctacgttgtcacaggctggcatttcggtgacaaaaaagagatgcgtggttcaacctactgggcaggacctttacaaaaacttgtaaatggtcaatggatcactgttaattatgcatagatcggaggactagcatgaaaatacttcaagagtttaaactttaccaaccgggatctggcgaataccacgccaacaaggaaaccaaggagcttaccccccaagaggttgaggattacaccgcatacactgggtattttttacgtaatgatgatggagattggtatgtgcagtcacgaacattacgacaagaaaatccgggttgtatcttcctacttgttgacgagaagggaattcttaagacatctacagaagaacctgatgccttatggcctgctccaggtcttcgtgtggttatcgccaaaaaagaagaggtaccagaaaacattatgcttcaccacgacgctttgcgtttagttggtgatgaatttgtcacagataatgaattctttgttcaacaggcagagggtgtcatagagacagaacttgcttgggctactgctagaattggtgcctatcaagacatgattgaccttgaatatgatcttactgatgaccagaaacgtaacatcagagatttgaaaatgtacagggtaaaacttcttgaaatagatacatctaaagcccctgacattttcttcccggagcgacctaccctctaagaggaggtgttgtggagttggatttggcggcattgtacggtatctgcatgggtaccgttgtcccgatctgtgtatgggctttcaaccagtggcacaccaaatggaaaggcatttccaagaggttggatgaactggagaaagacctcatcttagtgaaaaacagtatggttacaaaagataaacttgattccgttatcgagacccggttaagcaagctagaggccgatattaacgaccttaagcaggatgtcaggacagatgtctccggtatccgagctgatgtacaaaagattttgcacatgctcgtagagcatagtaaaaggtaaacaaaggtcagaacggaaaggactccgttcttgcattttgttctctaaagtgttaaaatagtcctaaggaattttctcaggagaacgcgatgactaaaccagttatccctcttgatatttgggccaatcaggatgttgtgcttgaaaatacgggagagttgaataagtctcaaccaaaaaaagaagagagattgaaaggttgggatatgacacaaagagtggcatgtgaagttgttaactttgaacttcacatgctttctgcgtggttaaagcatctaacagaagatgttgtcccaggatgggataatagattcttaagggttactaataatctagcagacgttccagacaaagctgctgcacgtcaagttctcaatgtatactcgcctgaagaaatggacgatctgtatgttgacaagtctggagacataatgactcagactcaaactttgggccttcaaagaatcgagtttgcatctgcgtcaacagacaatgcggcaatatataccaccataacctcagacaagacgatgatggatttctggattatggacaacattggtggtgctgacggcacagatcttgatgatccttctcaccaaatagacgggttccgttggagatttcagccttctggtgggcagcctgtgttttcggctatgaagctcaatgctataactgccaaccgtgcaagactggctatccaaggaaatcttgaatgcaacgatgcaaaaagttcctctgcaaatgccaatgcggtcacgataccaagagccactgttaacggacaacaatcctgcggaagcgctcaaataggtggaagagttgattgtaacgatgaaaccgttagaggccaatatgcaacagttggtggaagaaacgtggtccgcagggtaaatggtaacagcgcagacggtagtggtaaccttactatccctatgcctagtagaggggttgacgatgtaaggatagcaaaccgtttcaaaaccacctacagagagtcaagagtctaccctggacatgtgatgtgctctggtaactacgcttataaacacccttatcaaggtgattactggacaggtgctatccaaaaacttgtaaacggtcaatggatcactatatcttatgcttaaaaagagggtaaatgaaactaactcagtttttatggggattggttgcggcatctgatgaccctacgaaagtgtcccaatctaagctatggtcgaacataggcatggcggtaatgactggggtgtttattcatatggggtataatgatacgcttcctgaatggtatgcgtggatatacgcgccttcggtagcttgcccccagcttattagcaaattcatctcgctccggtggggttgccagcaccctgaccacgttaaaaacgaagagcaaaaagcttaaggagaaatcatggcgcaagacatgacaagctttgagcaggcggtagatcaagtaattgttgattctgaacgtttgcacctgattgtcaacggtaacgctgtggatgaagttgtcgtagaggatgggaccaccatccctacggtacgaaaagccatgcttgacaccctttattttaaaacgccaccgatcccttgggcgtatggtgcatccacaacagtttttaaccagctgtatgagtttaaaggggatacaggccctcagtggtggtacgctcccgcagcatcaaaatctaacccggttagaatgccagcagatccttcacaatctccaaactggagattatacaccgactctgcagtaatggcaaaatactacgcaaaacttaacagcccaaggttcgaaggtgacccgcgagtacctacacccccaatggacgataagtcagagtccatagcaaacacagagtttgttgttgactatgttgatagcatatttgaagccatggaggggatgaaagttactgtagggtctttggtggtaaaaggtcttacagaactcgccaacaccatagttgggggcacccttaccttacatggacctgttaatggagcagattctactgcacgcttcaggaacctaatcctcacggcaaatacttctacacttacttttgcgtggagcgatcctaagcatacagactggagaagcacagagctgcaacctcatgaagtgtccacccacagggttatagctgacactataacttctgggaaaccagtggctaataataacgatgtacattttgatggtctgggtaataacttttttgactacgtgtacattcgtggtaatgccatgaaggcagcaaccgaaccgacattgcaggtcgatgggaccaccagggttaagaaccttgaggtgacaggtaccgttacagggataacctactctgtcgatggcaccatgatctaccctagctatattgaaagcacgggcgatgcattgataaatggcgatttggaggttggcgggtctgtagttattcgaggtacagcctctatccaaaatatagctctgaatactctaagagtcaatgagcgtgcaacttttgaaggagaagggcttacagctaataaaggtacaattaccgagctgacaaccaccactttaactgcaacaactgcaaactctgaaaactgcaacgttaccagaaacttgcaggtaaatggagatgttagtttaaacgcagcagggacgggaaccacctaccttcacaaccttgaaatatccggcacagtgactgggtggctgccagacttctctaatgtcaactttgtttgtaatggcatcaactccagtggtaagataaccacctctcaagaaattgaggcgggtaaaaacattactgcccctactttccacgcaggaaagggagatttttatttagaggaggttgacgcgtccagtgggacatggacacctaacggacaggccagtatgtatgttgtccacgctaaaggggattttacaataggtcagtggcctgggacatcagcggaagataaaccttatccattcactgcagttatctatgtaattcaggatgctgtaggtcacaacgtgactttgcacgataagtatgctatcctgtcggcaacacctgttattaacaacaaggctaacagtgttaccctgctgcaattaacatattgtggtgttggtgatatcgtagacgtagtaattgcacaacgttaatatatctaaccgctcctgacggggcggttttcttatctggagaacacaatgcttccaatccctttgctaaaacttggtcgtcatttcctcgataagaggggtggaattaaggaacttgctgttctgtcatacccaatagacaacagtgatggcacaagcaatacagtatcctatgtaaatagcttagctatactttttgatgatggtcagcttaatattactggctataataggttcggagagtgtcggactggagatcttgatacaataaactatcctaatgaggcagcttggaacgtagaccatgtttggagagctgaccgtgcatttgtaatccgcacattcgataataaatttttctatattggttgcacagctggtcttatcggatcggaggcagcaggtggaaacgatgtttgtgtcagagagtggacacctttgccggaacagatcgtaacagggttgcatttggacacccatcctgagagacttgttgaagtaatgggtggcgtaaacaataccgtgtgggtaattgctgcaccagaggctgatggtatgcttcacctgtacggctctggcaataatacttacggctctcttcatgttgacaaaagtcaacacgctactccagttaagatcggtgaaacatctgaaagtccagagacaggtccttggaaaaatccaagaattaattgtgaagttcatgacaactcggttatttttggtggtcctaacggattctggattgcaggttacgatttcttaagaaataacagcaaaaacacactagtttatccagccgagcatgtgactcttgaccagtttaaaggcatcccggtgggcgagacatggaaagggttcatgtgtggacctaatggtgcaattatagccacagaaaggatgcacaaacctgatgaccaacagcttgttaatgtgttttatggtcaggatgtttggggtgacgacacgtggagaagccttaacatcacctatacccatgaagtaattatggctcgcgggtacgggactagcggaattttcttcaataatggtacaaaacagtaccgtggtttctccagaaacctgtgtaacgatattggtgctcaatctgctaataatagtcctagggccaattttattcattacagagcgctggcaacagctaagtttgttgaacagacagagccagtaagctggacagaaagcgtttattttcaagggatccacagggaaggtttcttaggcacattctgtgtggtaaatggaaagctttggtggtcaggaataccacgtggtagtttttcaggatctaataacctctttggcggcagacttaacagccaagggttcacagagattccggagaattggtataaaaatgtcccggtagatagctggggtatcgaagacatctttgatgtcaatggtgtgagcaatgttagcaacatttacatcggagatactgtcaagatgaaattgaaacctcagccggagggtgctacgttcattattgacaagattgagttggtaaatgctgcaggcactgttgttacagatgcaaactatcagttctccactaactggaaccatggtggtgctaacgaagttgtggtcacccagtataaccgtaacatcaacagacgtggtttgtattctatcaagatcacctaccatgacaagcatggcactggaagaacctatacgacaaggactttgaactggaacactatagttcctgcgtatccgtccaacggcaagtggcataccgttggtagaaacaagcagttccatgttaacgatactgtatactttgggctgaatgggacccagcctgcagtagaaggggatacatcgtatatggtcagactccacagaatggatgctggatcagtcacttatgatgtgacccaagagatctacgatcaaagacgcgccacgtatgacaatattgtgaaaacacaagccttgtgggagttcaatcctaatggcaagggtggtaaaatgttgcaggttaatgagcagaacggaacgtcgttgactgttcacgaacacccagacccttggcctgatcctggaaaacctcacccgggagctcgtacactgaaaattgtcagccatgatgcaggatatttcggaatacgctgggaagctacagtaagatatgtcgacgggacaacaaacaacatagggattacacttggcggcactagtgaagataactcgctgaaaattgcctacacgcccagaggtatctctattgataatatggatgttgttcgcaatggttacggcgatgtgaatgtcaaagttactcttggcgaacatcttggtggggaaaggatcatcatgtatgcctttgatcatgatccacgcaccaatggaacttatgcaaatcaggcatggagttacctgataaatgcacctgagccgaatactaaagagttctactatggtatgaagcgagatgtgtgcaagaaaacaggaacacatgactggattgctatctgcgttaaagatgagcgcacagcttgggatgaacctgttaacagatggttcataggtattcctaccagaagtgataagtatgtcgcagaatatattgtatgcatgggtggtaccaacctgaacatgtgttggaacgaggatgcaaacaaatactctgattatgactatatgagggattactcttgtaatcagtggtttaaccaatcaacaggataccctccacgtcaggcgagagtaaaccctgcaatcttcacagatacgcaggttttcttgacaaaacaggccaacgaggttcagaccttcaagaataaatacgatcctaacaagtggttctacaactgttacggcgcatttttctggggacctggtgagttacctggtggaggatcttgcttgaatgaggcaacttacgccagtgactacatcatggggcaggtcaagaagtataagataatccccggtcctgagactctgggcaatgccgttgacccttatatcatcatgactgcactgagatcaaacatggacgggacatccatgtctatgcaaattccggtaacaaacgggtacaaacgtgttgtgatgatcattaagtgcgacttaataggtaaacaagttcttgcagaaaacgggacatccacacatccttttgagattgctctgcactatcagtttgctgactcgccttttgcaggtgataagagaatatctgatacagatgcacagcgttgtaagaaagtattgttgggtgcaggttggtggtggtatgagtttgatttaacagacaaattcaccgacacatctaaagttgtaacaggacttcgtctagaccttggcgagaacatgcacaaagctgtttgtgatggcacctatggtgaccctacaatatacctaaaatatatttcttttgagcatccggaagatgttgtctatggtccaaaactgagattgtttggcagttggattgcaaaagatagggtaggcatgggtaagaaggtaagagggttcttggttgatgcaggaacagaagacatgctggttaatgcagtatggcctgaattacctgggactcagtgggacaactcagccaaatctataaactggtttaacattcatagggccatgtggaccactaactgctacttgtggagagagcttaacgatcaggcctttggattcagcgatggtagaaggatggcgatcatttgctggacaacactgcaaagatgttatgaccatgactatgagattgggggcagggcatggaaaaatatcagggatagaatcataaccaattttgcagacgacaacggtggtggagcacataactttggcacaagccgactcatccatttgaacggatcctcagcctacaagaaagaaggttactctgggtctatgatcgagcggggtctggtgaaagatgctcgcgtattgatgggccagcaacttgctgccgcaataggtcccagcgcagtgcagtcggttaaaccagcgtggttcgatattccattgtggtcacccggaacaccgggaactgctgcaatcaaccctaccactggggatctagaaatctcctgggaggacttgaagcaggtcggtggttgggacaaaacagggtatcaggttcagtggtggagggctgatggatctttagccgctgatgagtttgttaaggacaatttctacactatgtcctctgcaaaagcacagcaattatttggtcaggcaactccgtcaacgatcaccatgtctatgtgctgtaaagacaacaggactggagctttggggccaagggttgctaaagttttctcaggtattaaatggaatctacctgtccaaagtatttcatggaagcaaataggtgataacaagctgctggttacccctgcctgtcagttcaacgcaactcttaacgttgatcctgctgttgcggcaaactcagctaaagcttctgacttctctgtgtctaacactgctatggcagatgtgaggaagattgacacgctgaacgccagaattacctgtaaaaacacttatggcacattccagatcatcaacaacttcacagatgctgattctaaggtagtgaggacagcaagccagactttgagtttaggaactctggcctatgcggccctgatcactgaacagtcggcaacactccaaggaggtggtgtaggcaagtccattacaacacctgtgtggaagccaaatgagtgggttgtgtttgatttgactgtggacttctccagcgataataactggacatgggtaaggaattgtttgtcacagttgatgggcggtccaagctccgttagtgatagtcacgactctactgacccgagtgtgttccaggtaggtaaaactcacccagagactggagaaacgttgcctgacaggaagtatgcgttggtttgcatctcttacgggaaggcagatgtcaccttctcagggacacacacttataacggaacctacaatttctcaaggaagtatagtctcaaagcagggaacattatagacgaggttggtgtgctgtataatccgggcaacggcatagggattgtgggtggtaaactgcagatgcaggaaccttctatcaccccttccaacgtatccgggattagaaagacttgggaaagtagtaataccaacattgcaacagtggatgccaccacaggactggtaacatttaaagctactgggaatgtcaccataaagtttgtagttacagatgatgcaggccgcaaaacgtcttcaacatcgtttactgtcagacagatggcacctcagtggtttatttgggaaggaaatcctcttgacggggcctaccctagacctgcaggaacgtctaatatgagggtctttaccggtccggtaatggacaatccaaccacaaccaccaaccctacattttttggtgcttacatacctgaaattattggcctaccaaggaaccagatacaactgcttttcggagcaggtgttgatggtctagccacctttgggtacagtgacaacatcgatgcagccagaagctcgggctggattggatttaagttccagtggaaccctggtggtagaacattaggtattgcaagtataggtattatgctacctggtaaccagcaataccatcttgaggcttatacaaacttccccagttaacaagaggcaaataaaaaggggccaaacggcccctttctttttataattagtaatattcccaacacgacccatcttcagacggctggacacgcttaccttcatgatcgacataggtgtaaccacagccttcacagataacaggtgccgcataaccttccttccactgcttctccgtgatcaatcctttcagatctccgcagtcacgaccaaacaactcttcagaacagtctttacaaaaatcagccatctctatcagtctccatatttaaccaatctatattacatattgccgaagaaacagtatttcatttcattatcacagatctccaacaacttcccaaataccccagtgagcatctatatccctgataaagtatctttctccacggtttgtccacacacctatcccaactttaccatctatcccattgtatacatctgcctcatactctttgcccggtgtaaagtgtacacccatcataagggctgttattccgttaggatttttaaatttaacaaattttactttgctcatattacttaatccttgcagttacagtagcgctataccccatgtagttatgagacataaagaatgtaagccctttaagttcaggattctttctaagaaatcgtttcaattttcgaatgcaattaacaccatgatcatagtttgagaaattaaatttaataccctgctccatcatagtgcacacttcttcatgggtatgccattgtctatcgtggtcacaaaaccagtaaccaataccttctttttcttggatatgcaatccccaaaatactttatgcattggatattttggttttctgccatgataatgtagtttaatattcacatgtgccattttttgttactccgttctgtatctgtgataatgagaatagcaaactggggtgtgtgctgtcaacaacattttttaagcgttttggggaagttttttgaaaggtgggtgtaatcacaagagagggtggagttattgaaggcacaggcctcttttgaggccttaaaatcgattatgacactttgacgtagcgctctgacagagctggaaagccaaaagcagtacctacactgccgtacgctatccaccattgaagttcatcgtgacaccattttccgatcagaaaggtgcttgggtagcgggtcagtattttggcataagctttagggtctgcatcctctgggataatgatgcttggaacatctttgttatgaccacagcagcagtttagagttttcaatcctgccgcccatagactcatgataggcttagccatgcacttatcaaggcacacacgttttttgccgtctcgaagttttttaggcacatcgacgataacatttggatgcttggcacctttcactttccaattataggatttacacttgcacatttaatcagtctccgcctagaaagcaatactttacttaaaatctttgtcacctattacgattgcacgaatccactcattgtgatgttcaatggcggtaaggtgtaacataatgcagtgattgtcattactaaacacggtgcggtaagctttggcagcaccatgatataacttccacatcaggtaatgatatcttcgcctcatgactctttactccggttcagggtctgggtaatcttcaataataaagggccatccgttccgcttagcctcagacttatactcaatctccttcattgcaaactctaactgattcttagccggaatacatgccggagaatcatcaatccagatatctgggtagatatcaaactgcgccagataggctgccttctgaacaccaccagtataaaacacaccaacatcaagctccttgcgccaatactcaatgtctacattgtcttgagtaatgaatcggaaagtcacaaggtagactgtccacccctccttcttcagatccctgatcaggcgggagaagatgaaagggctcgcattaaacgttccatcaaagtcaatggcaatgatgtgcgtgccgtggcgagtctcatatggattgctcgtggtaagattgctgtaattaaaagggacttcttccccgcagtagctgtagtccatattcacaccttctcgttgataaatttacgggcggtttggtgagttgtttctgctgtcttcagaataatattaattttattgtcaagatcattcatctctgcagttaattcaggaatctccccggcatgcatagtgaaatcatacatagacatgcccagaatctcattgatgcggcggttgcattctgcagcacgctggttcattttccaagctaacaccaaagcctcctgcgtagcctctagtgcaaaatctaatacgtcggcctcttctttcgtcatctttctctcctgttgtattgttggtaggtgtatgaataccttataacccacctttttattcaaactgcaatagtaagtccaccaccgcgctaggtctgtcaacaaattccccaggtccacatgcccacagagggtatccgtccacataccgccaaatccaacctgcagtgtggagttcgagcagggcagtaccgtccttactgtcaaccactctttcccacagtgttgggcagcgaagcttgagaatcggatcacctcccttatacccgtccatgtagatacccattgcaaagttcagcatcatctttttgtgcactgatctcttactgagggtgctcatcacttcctctttgtgaatgtttgtaagcttctctttggctacccgcagatcgttgcaaccattgttcagcagatcttccagacacttgatccggaggtcgtgaatgtctttgtcgtgtaccgttggcacagggtcgtagcggtatagcactgttgatacaaggttgctcgggtgtgggtctgacagcaacccataaccccaatactcttctgtatctgaaaggacaagacacccaatgtctctgtcaagctttcctgtgttgtaagccacattgaccgccatgactatagctccactagcaaagtgctttcaaagtgccgttcatgcagaccgttgtaagggaccacttccacaacaccatcacggacatacggggccatcatagtggtataatctccaaacgggttggtattgtcactaaccacaaccaccttctgcccttccttggcagagtgccaaatagatctacacttcatcaggtgttcgagagctccaggtaaaattttgttacgttctttacgggtcttcataacagatatagctccttatgaaagtggtcttttaatttctcactgagaaacttcttgataccttcctctaaagtgttttcgatgtagtccagcttaactgcttcgatggacatatcatagattgccagctctaagctgtcaagtcccatcatagcatgaaccataagattttcatcttcagatacattcaggggacttcccataacatctggaggcagaatagtttcccaattattctgggtggtagttctcccgccatctactttacggcgcagttcgaatgtgttcttagtgtagaacacttcataagaaacgatacgactgtcactctcataataaacgaagttcaggtaggagcctagccgcagtcggcaaacttccaccccaaaccattgtttcttataagaattcaggctaatgctgtcgcattcacgtttgctcaacacggctatctcctttttgttaatcttcgtaaatcaggatttctgctttaggttttcgtgctttcaggtccagctctatccagtgcaccatagctgtttcaagaaaaacagcttggatgcatccgtcctcagcgtgccccaccaacataacgagatcttcaccttcgtcatctgcatcacgaacataaagaatctctccagattcgaagtctttcacaacctgattgctagataattttcgaatttttgccatatcagaaaccctctaaaaagctcttgtagaaaacaatctcagtatccacaccagtcacaatcttgtcgttcctgatttcatcggtaagataggtgtcaaaacgcagaacctgtgtggtgttgtcacacatccactcagctgtgaccattgcgaaaatcttagcatcttcattatctggtgtgaatgttaccacctcaccgcacttaaacttttcgataggctgagtgttagctttcggttctgcgatagtgatttttgtggtcattattctcctccttcttttgaatagcttgtctctccaaggatggtaattttggtgtcaagctctgtaactttcatgtttggcggcagatcgtacaactcattattttctaaatcgaacccccacacacaatgttctcctgttttgacaatcataactatgttttgaatgccgtctccgtcgcaacttaccacggtcccacacggaaaactgtctgcacgctttttgttcttcaccttagaattgaatacaatgctggtagccattattgttcctccaccataacttcgccaagaatttctatgcaggcatccatttctgtaacaaccaaactgtgaggtagttctacaaacacctttctgaacagatcaaataccccaacatatatgtttgcaggatgtgattttacaacaagtgctgtattcacatccccaagttcatcaacaaacatcaccacagtgcctggagctactgaggacagatacttcttagttttacggtttgatgcaaattttaactctgttgccataaataacctcctctcttacttagcgtactcgattaattccacagttttcccaaagctcgggatataatttttattatacccttcagttaggacccatagagtatcgtactttttccacttgttgtcaacagccttttgttcaaagttatgctcaaagtataggtcggtcaggacgatgacatcttttgcattcggtatgttggcatccagatactcgaacacgcaagcagctgttgtgccccatgttgagtggacctcatagttgatcatctcgtctatgttgccgcgagtgtatactttaacctctccaacctcagttgaccaacagaacattgtaaccttaaactctttatacagattgcacaatccggtgatttcattgaacattttctttaaagttctttgagagatcgagccagaaacgtctaaagctacaacaatatctatggtgttttccggattacgaccaggaacaataacgtgctggttcttgtttatagccccaacttttcgcattgtgctggtcaaagacccagatcggcgaccaggttttctgtaggtcagttcagcctttcgtttagacaacatgcgttgcttaatgatgtctatatagttgattacaggcttacccctgttcttgacaaactcacgcaccgcctcagggcaacgacctccggaagcttgcattgctgcttccagcatgtcaccagagtcttgcatggcctgatctttatcagattggctgattacaggttgtggctgatcataccccatagcctttccaagatcatcgctggtgccaccgttcccgctcatgtgatcatcggtttgtcgcttatctccttgagaattctcacctttgccgctcttacttttaccgttattctgatctctttgcttatcaagaactgcatagacgttctcagcaatccatccatgaaacttcatgtcgcagtagcaactagctaagaagccaaaaggcttaccttttacgaactcagtgcttttccccttcgggaagaaaacacaaggaggcttgctaaagtcaaccacaagacctgtgttgataacgtgatcacaagcaatattgaacagttccggctcaaagcttttaccacggaccaggtgatcacagataatatgccccacctcatgtgacagaaggaaggccacctctttcacagattttggggaatagaaaacttcagccatctcaaactgctcgtcagttagagaagccttaagaatagccttgcgttcatcagccaatcccataatgaactcaggactgtaatagatgcgtttatggtcggttgccatggtggagcaccatgtgtggttttctacgaactgcaaccctgacagtagtgtgccataaaacggcagcttttcaaggagatacatacgtgcagcctgcaacattctcagggcatcatctttctgtgaggcaatgatttctgaacttctgctatccattaaaactccagaaggggccattggccccctgtcattatttaacgtgtttgaaaatacctgccaactcggtcattgtcatgcgggtggtcttcataagatctgtcatagctttctccataattggagatactaccataaagtttcctttagtgaaacctttattccagtcggtcaccaacagtggtttaagtccagctccgaaacgttcaccagttaaagcacagcatttgcgaatatacgaactcttaaattggctgaacgacagatcaactttcatacctgcatcgtagaacgtttgacaatagaaagtgtaagccttagcaatctcaacatcatcaggcagtgcaggaacctcttctgcaatcccctcttcgacctcctgaggctctttttcctcttcagagttctgttcttcaacttcttctgtcacagtctcgttcacgatgtctgaaatgtgtttgttggctgcacgatcagccatgaaatttttaaagtcctgcattggtgacatatcttcttcctcttcgtcaaatagtgctagtttatcttcttctgtcccgtattgcaagatgaaatcttcaaaagtataatcacctttcaatttctccatacgctcttcgctcaggtggagcatcatctgctggacaatttttcgatcagttttgtctttaatcaggattgcagtctttttatctaccaggcagtctttcagagcattgcacctcaaccctaccacacaacaattgtcaattgcgtaaggaccttcatcatctatacgctccaaagatgggtagaaaggattccccagcccgttttcatctgtgtgcatgtcaaaaggtataagggtatagtcgcatactccatctcctaaaagttttttaccaaataggaggtattcttcccatgacaggtcgaactctatatctcgtttccgtgcgttattctgtttgcgtctatattttttgagcaagcgctctaactcttctggtgtataatatttttcaagattcatgagtcgtctctcgtgctctgtaagtgaagaaatcgtatcaattgtctcaacagatgtcaacatcaaaaacgtgttgactttactctaactccacaatatagtgcacccattcgaaagaaaactaacataggagcacttacttatggcaaatcttaacagttttagtacgcggtggaaacaggacataacaaccaatctttcagctggggacatcctttctgcaatttacgaggatttagatgctaaagctacttcaaaagcggtttgtaccaacccactaattcctgtagtgatgaaggttattgagcgtagattggtatctgggtctgataagtggacatatttagataatgaaggacacacctattccaatgggtacgtcgatataaaagtagaatacgcggtatcataccgccggagcggttctgtaactttcaacttctctggaggttttcgatctctggctacctcaccttttgtttcctcagaggagaagtatgagctgccatttctttggatgatggctaacgcgacaggaaaaacccccgttagcatccgagtaaaatacaactacaacggatctagtaagatctatgccgaaagtgtctcagcaagtttttattttgtgatgggggatggaatcctcaaacatataaagatgtgcgatatgcatgatgttataaatgaagtgactgataagaatgttctagtgaaagacctcaacaatttttatacacccggagactattacgtcagccgtccactgtgcatctttaatgccgcacaccctctaggtgagtatttgatcgccaatagcgatattgccaataaccgcttcgaggtagcaagagttcagaatgaggtattgacatcttgcaagagcggtgataagtttaccgaagaagagatgggtgttttagaaatgatgggatataagtgtagcctttgggtagatgaggtgtttaatgattgcatctatggacaggatatttacccattaaagaagtatactgatacaagtttaatttatgcgagggtttgactatgatgaaggcatgtggtaatgtatattacgtcggtgaacatgttcaggcagacagtgtgtggaaatctattaagtccaccactgacgatgcctttctgagtggactatgtttccccaatccgggagacatcctccctcatcctagagattttgttgtcaacaagatggacggttataccgtgtgcctgatggttgaaaaaatctttttagacactagacacaatcaccgtcttgtgttaaaatttcaagaatgtaaaatgacaattgcctaaggagaccttaccgatgtctaaagttacttatcgtgcagctatttactgcaatgaacacccaatcaataatgatggtcactgcctttttaaagaaaatcagttgggatgtattgtcctccctgatgaagggaaaggttatctgattgcattgacagggtttgaacctgaagctctggaagccaatctggactacctggtagaagagggtgctgcagacctggttgccaatggcttctccataagccttgacgaagtggagcgcttcatgggcaattaccgtgtagtgcgtgagtttactatcgaggtggaaactccagagtggggtagccatgaaactaatgccgaagaaaaagaagaggaggtagaataatgaaagtgcagatcttgactaatgccgagaagatgtttattgaagatacaccttttgaagctggtgagctacagttcatttattttgttgacttagataaggtgttccctgcactgaatcttggtctggatgaagttcctcataaggttttgtgccaagttgttcgtgcattagcggcagatggggagttccacacccttgaagatgtccagacctacgggtatcttgaactacaacgagaagaagaggtggactgataatggccctgtggaagacaacagttgaccttcatgatcagtggttaggacgcatcactgaagacgggaagctagtggagtgggacaataagcatgttagcgagttggcaagtattgtggctggcaagttacgctccaagttccctgaacaactggatcctgatagttcaaagttcgatcctgagttggaggatgttgtatactacttcgacaccgttgatgactacgacgcgtggtttgcagcacaggagctttacccacaaggctctgctatgcgccagatggaagaagattatcctccgtgtgagcaattcaacagtgcaatgacttgcctctatgattgggcagataagaaccttgtctggattcggaccgtattctagcaggtagtggcaaggatgccacttaaaagagtaataaacatgttataccagcaatatgaacttcgtgcagaaaaagagttaaattttgacaaagatattcacagatattattatgggaaagttagagggcaagcaagaaagtgtactccaacactcttttatgccagcagacgactagcgccagaagaggcaacagcagaaagggttgcatacaactgggaagttgtgtacgatattgacagatccgatgtgatatctgttttggaaaactttgaaaacacttacacacaagtagaggacttttactaatgtcaagaaacgtatttgaaagtggtcaaatcactgtccgtgagttgccagctatcattcagtttgcccagcgtcataaccgatctgtcctgattttaggaccaatgggtgtgggaaagagtcaggtgatgaagcagatcgctgataatatgttcggtgagcgagatgacaacctggttgacgtgcggctgtcagataaagatcctgccgacttatctgggctacctatccctgtagaagcggatgggactacacgtacagtgtttgcaatcccagaattttggcctgcggatcctgactggagcggaattgtctttctggatgagctcactcatgcagataactacctgcaaaaggttgcaatgcagattatgctcgaccacaagtgcggcacctatgcattccctaagggctctgtttttgtagctgcaggtaaccgttctacagatggtgctgttctttcggcgctcgaagcccctctggctaaccgctttatcattgtagaagttacaagcaacgcagaggtgtttattgaggactacgcattccttaatggggtgcactcctctgtaattggatatctgaaaagagttccatcagctattgataattatgaggccatggctgagattaattgtccatcttttgccacaccgcgatcttgggttgctgcatctgatatcttgcacgattttgacagcggtattatttctgacgctatggcccgtgttcttctacaaggtgctattggtcacactgcagcggtagagatctggacttaccacaccaagaaacgcaacttaccggaaatcggtcggattatggcaggaggttgcaaagaatacgtaggccctaaacagccagacatcttgtggattcttggatctgaaggttgtatcgctattcgtaatatgatggaaaatgcaagtatctccgacgaagatcttgttagctgtgtggcaaacttcctcgatttcctttgggaaaacttcaaggacgagaaccgagattttgtattctcagtctttatggcgatgatgaaacctaatgccttaggaaatgccttgcttatcggtaaaggtcgtgacaagattgttgctcagctgatcaaagcatacccaaacctgatgaagattgtaaaagagtttggtgaagagtttagcgccattttggctaaagcttaaggaggttgtatggctaaagtaggtaagcggggaaactacctggtggtattgaccgaggagccggagaaggagtacgaatgcagctccacttgcgtgatcgatatccgagaaaaagatgtagatgaaatctggtttaaaatattggacgcttgcgatagcagtgattatttcttcatctatgtcaacgataaggctgggttcttccatgacgacggagagttgccgtatgaaatctatgaacttgtagaggcttgccatcgtggagatgcggagttgtttggcttacggctgaaaagcggtaaattcttctatcaagatgagtgcatgaatcttcataactttgtagagggaacttgcaacgatggagagattttggcacactacgattaatttctaataccaccccgcttcggcggggattttctatttggagttattgtgaaaattaagatctttgctattattttgagcgcatttttatcgctgcctgttgttgcagcaccaaaacaaaaagtatatcatacttgcaagccctcagatactaaggaaaacattttggcatgtaatatctacagggaagctagaggggatggcacgatgggtatgctggcatctgggtttgccacattaaacaggaaatctcaccctaaatacccagacactataagaaagattgtctaccaacctaaccagttttcgtggacaaaccacggcaaaacttttaaggtgacagaaaaagattcatgggatcacgctaaaagtcttgcaaagatgcttctaaaggtctataataacaaccatgttgcatacatggctatggatataacaggtggagcaacacactaccatacaaccaaagtacgaccgaaatgggcaaaaaagatgcagaggacagctcaattcgggagccatatctactacaaggagcgcaataaatgattgtaaacagtaatgaaactaaagcagtgctaaccggaaatatggaggtcaccaggggctcaatttctctgaacaaagagacttttgggctaatcattaaagggatttacgaagataaggtgctggcaagctgccgtgaaccaatcttcaacgctgtagactcccatgttgagtctggacggggtgatgtaccgatcatcattcactctcctacagaccttgaaccatacttctttgtgcaggacgttggattgggcatgtcagaagagatggtccgcaacacgttcatgaaccttggagagtcaaccaagcgcaacagtaacgctctggtaggtaataaaggtgttggttcaaaggctccgttcagcatggtggacactttcgatgttatcagtgtgcacaatggtgttgaaagcacatatctattgttcttggatcagggtatcccaaacgttaccaagatccgcgagcggaagactgaagagcacaacggggtaaaagttcagtttcatgttaagaaagagcatgtcctgaaatatcgcactgctattgcatcgtgcttacgctatgcgaagtttccgttcaccgtcaccgatcccatgaccagtaagatgttagaaggtgacaaggttgaggcacagtatcattacgagaaggatggctggaaaatgaccatcctgaaaggttataccagttctgatgagagccgtgttgtgatgggtcaccaaccttaccgctctaagttcctggagacattgaccgattaccctgcaatctgcgtggaaattcctatcggggattgcaatattaaccctgggcgtgaatggaccattgagggccatgacgacggtggattccaggatcgcctggaggcctttgttaaagaaggtatacgcggggcagaagttgttgcagaactggagacggcaaaaacctcagcagaagcacgtgaaatgatgaagaatagtggggtgttcggacacatcttcggcaaaaactttatgtggaaccgttgggaagaaacagggcttggcgacttaggcgattgtgaaattttcgctggcggcttaaataaaggccgcataggctatgctcgttacggaaagtcggagttcttacgaggtgtataccttgtatttaacgacggagacggcaaatataaccgaaataagtgtaactacttaagcgagatcaccggacgcaacgttttctattgccgtaacacggatctggtggaagagtttaaagaagcggcacaccacccgttctttgcagatacggtcaaattgttatcagagctccctcgccgacctgcgaagaaaggtgaaacaaaaactcattacgagccaggttattgggttaaaaagcttgagaaggatggttacttccgtcgtgaacgtattactaaggcagagttcaagaagattaagcactgcattccttatgagggtgatatccaacgtggaagttgttggctgggacagctgagtaacatctaccagcaaaattatgaccgtgtgcgtgcggcactccagattcctgaaggggaagacctgtacctggtatcagaatcccgtctgctttggactaatcctgattgccagtatgttacagagaaaaatgtggaacatttgttgaaagaggacgcctggaaattcttactgactcgcgcagcaaatgaaacttcatatgacagcctgtatagacaattagggaaaattatccccatgcaggattttggaaattatcggccacatttccacaagtgggaaggtaacaccgcgtggaagcacagtgagctaaatcatcgtgccaaaatcttaatcgccaaccgggttaagtgcgggaaggcctatattgcaagattggaaaagaaatatccacttttgaagcatgtgggcttgaatgggacactcctgctatgattgaataccgtgaactgatcgatacaaagaataacatcaaataaggagaccaagatgattttcatctacgaacatttcaaaactcgtaaagaagcacgtgaccgccgtgcagaacttgagaagaagggtttcacatgtgccattgagaaaggcgacacaacctggacactggcagttggtgccccagagttgttcgatcctgaccgtgacagcgtctgctacacccgtgaggattttgaaacccgtgaagaggcccgtttatttagatatgggctggaagataacggtaagtacgccatgatcttagacttaggcgaaggttccgttaaacgttggggcgtggtatacccactgtgtgttgttcacggtgtggggtttactggggtagcaatcaagtcagaagaacctttagtagaagtcaaagatccggtgctggaagtggtgagcagtgtgtctcagcaacagactcgaagcatcgagcctttggtagttatttgcggggaactcctccagatcacctgcaacgaaggaatttttgaaattcgccgcagcgaaagtgaggaagtttaccagaaagtcttcgaccatatctctgttcaggaatatgatgaggcaattggtgaaatccttgtctggctggaacgcaagaatgagttcaccacacttgcagacaacctgatcatgaaagatggtaagctctactactacggtgtagagatgcgatccaccattgcaaagaaaattgagaaagattatgcagacggaacgctggatgaccgctatgtgaaattcctcgttcgcctgctacgcaatccttctgcaaaatctgtaaacatgctctacgattttatgcaggccaatgatattcagattgcagaagatggtcgaatcatttgctacaaaggggttcagtttaacggcagcaagtgggtggattggcacagtggtaaagtcccacaataccaaggtgcttttgtatccatgcctcgtaactttgtagaggatgatcctgaagctgcgtgctcctatggcttacactgcgccagcaaagagtatgcaaagagctacggcactgtaatgactgtcatggttgaccctgcagatgtagttagtgtgccatatcaacacaatagcgctaagtgccgtgcatgccgctatgagattgtggtagctccggaagcacgcaaagatggagaccctattgaatatgtagttgatcgtgacggtaacactatcgacattctttacgaggaggcgtaatggaaaaagggcagtatgatgtaggcacagatgctgccctcgttgcaatcatgagcggtgagaatgtcttcgtttcaggacctgcaggttgtgggaagacgtatctcatcaacatgatccagtcaatgtatggagactcttgcataacggttgccccgacaggggtagccgctttaaacgttaatggagcaacagcacaccgaaccttcgatcttgcagcaggtgtgagcatggagtcagactggaccgcaataagggcaaaaacagcaaagcctttgaaaagcaaggcatttaccatcctaattatcgatgaaatctctatgatccgtgctgataagtttatagagatggataggaaacttcgcttccttcgaaaaaatgacaaacctttcggaggcatacaggtcatattgtttggcgacttttaccaggcacctcctgttgtctcttctatggagaaggaagcctacttcaacttctaccatacggacctgtgttgctataccgaatcttggaaagagcttgacctccacaacatagccctagtagatcagttccgacaggagtctattcgatttgccacaatgctcaactgtgttcgtgagggtcgtcgcataaaagaggttgtagcagaacttaatgctcgctgttacaaaggtggtgtaccaacagatgctctcacaatttgcgccaccaacaaacaagcagaggaagtaaacagaaggttctatgatgccatcaacgccccagagaaggtatacactggtgaaatgaagggtaagtttccctccaccctgccagttgagcaggagatgaagttgaaaattggcatgaaagttatgataaccgccaacgatgttgacccgacgcacaaagtaccttattatgttaacggaacacgtgccacaattgttaaatttaagaacaaggcggtggtggtagagcttgaagatggaacacaggttgacatagagcagaggttgtgggagaataacgagtataagccctctcagagatacaatattgcagaaaggaagatggagaagtttatagagagggtagtgattgggtcatacaagcaacttcctctgaaatctgggtacgccgtaacatctcataaaagtcaaggacttacgctagattgttacaacctagaccttggaaagaacggagctttctctccggggatgacgtatgttgctttgagtcgagttaagacaatacaaggaataaacttgttgcgtccactaagagaagttgacattattgttgacccgcgagtcgtagagttttacaatacaacattccctgacttagacaaaattgtcaggaaagattttgaaaccagagcagaagagggggacgtatgagtttgtggagaaatatcgttaactacgtgtgtggcaatccaactcctgaagagaaggatgttgtgattcacgattttactaaaagatctcgtgaaaaagatctactgctaacaaaggtgactgataaagatcctgcagtaggggactgggcaggttttgcgtttacatcggacaaatacacctttaacaaaggtgactatcttgttgtggattttaacgaagacatcgagggtgctgaaccttactatcagacccttatcgttgcagggtgtgttgatctctctgcaggtatgcacagtttgattctttttgagcttgactctgaagacctccagtagtaagatgtaagtataaaggggaggcactcctccccacaaaaactaaggagagcaccaaacgatgagtaaaaccaaattagaacttacctggataggtaaaaacgagcgcaaaaagttagagccgcacattttgttagaagattctagcaagtcttaccacagccagaaagtgaccgaaaacgatatttttgataataaactgatttttggagataacttattagcattgaaggcgctagagcaagagtacgcaggcaaagtgaagtgtgtttacatagacccaccattcaataccgggagggcttttgagcactacgatgatagccttgagcattccatttggctgggcttaatgagggataggttagaaataattcgtaatcttctaagtgatgatggggtaatattcgttcacttagatgattgcgaaatggcgtatttaaaagttttgatggacgagatttttggtcgtgcaaatcagttaaataccatatcgatgaccacaaattccccttcgggatttaaggcaacgggagccacagttttctccacagcaaactttttgcttgtatatgcaaaagatcgcacccagaaaccgcttaacaaaatctatatacctaaagggtatgataccggatataacaaatacctattaaacccggatgatcattataaaaattggacgtggtgcggtattgccgatgcgtttgcaaaggccaatggctataaagatgcaaaagaagccaagaaaaaactgcctgacacattcgatgatgaattagcacaatttgcaattgataatgcagaacgtgtatttcaatctgttgcaattggtggtggtgctaaaataaagagaaaagaaactatagagaagtcaaagaaagatagggataaggtttatgtacatccaaatgaggatgttgaaggattttatatcgcaaatggtaggcaaattgtcttttactccaacaggcttttggaaattgacggtgatatgcaacctgcggaactaataactgatgtttggacagacattagttggaatggaatagcaaatgaaggcggcgttagtttcaaaaatgggaaaaaaccagaagcgcttttgaagcggattttcgaaatgtgtacgcgagaaggtgatttggtattggattcattcggtggttcgggaactactgccgctgtagctcacaagatgaaaagacgttggatctccatcgagattggtgatcattgccatacccatattattccgcgcttggaaaaagtgatcgatggggaagatcaaggtggtatttctaagtctgtaaactggcaaggtggtggtggcttccgttattacaaacttgccccgaccttaattgcgaaagataagtctgatcaataaagagtacaatcaaatgatgaaacgttataaaccatacacttttgaaatcgatttcgaacttgacgatatgttcactgtagaagctcaggcagttgtccagttgccagacccggagtgccgtgattctgatgttgactattacggatttagacagattactgatgtgcatgtttaccacaacggtgaagaggtggacttccaccaactgccaaacgatattcgccactcaatttacaaacgtgcagcccgtgaactagagtcctatctggatgcagcgacgacagcagctgcatttgccgaagaagtgggaggtttctgatgattacaggtgtgaagattctccaataccacttaaccaaattggaagatgctgaaaaagagcttgcagaagttctgaatagtggatatactttgctatcatgcgcctgctcagacacctacgttgtgtggacacttatccggaaggaagagcctgcagggatcttggtgccaaaccctaagattattagtgaggtggatgactattcccaggacggcctgccagaaggctgggaagtatgggaaggtggtgaaaaccctgcaccaggtaagtgggtaaaatataaactacgtagtggtgcacagtacgctgactactctgatgacctagactggagtcattcttcaccaggatcgtctgcaagttcatatgatatcgttgcttttcaggaagaataaggagatagtgttatgtcagattttatgtggaaagtaggttacgcagctcctgaaatgtgtgaggcttgctttgtgaaaataggccgcgaggatatcgacaaagtgatccttaagtttcgtgatgtggctgtgatcggcaaccgagtgcttaagcacttaaagaatctgaagctcaccaaaaagaaattcttcgggcttttcgaagagaaagttgatgcttggacccattgcattcaggaagctaaatctcactacagtgctatcgttaccccagaacgggtagccaagatggaaggactcatcaacagcacagagtttgagtgtctgaaagctgcactcgatagttatccgaaatgcctcaagcacttggacaagtatgtagaaaaggatggggaaatgtatctcaccctggacgcatattatgagatgcaagaaattttaaatttagatttgacattggtatccaccgagtatacaataggtatccgggtttaacactaggccctgcccgaaagggtggggctttttgcattaggagacagcaaattgaaatttatctacaaagaacattaccacaaaggtgttgtgtggagcctatttgacggatctggtggtgcagtcattgactgggcaaaagctggatatctgtgcctgtgctttaacgcagaaggtgctgaccacggcagttatgcagaggtgatcaccgatcatccaaatattcactatgtagattattggattgatccatggttccctcaggaaactttctgcatgtacccagctccggactttgttcttgcatttcctccgtgcacccacttagcggtgtcaggtgctgcacactttaagaagaagctggctaaggacccgttgatccagattaatgctgtaaaggatgctcgggttgcagaagagttgggagagatttacgattgcccgtggcatgtagagaatcctgtgggtgttatgtccacactgtggcgcaaacctgattaccgttttcacccttctgactatggcgggtatttaccggaggatgatgtaaacccctggtttcctgaatttatagctccacgtgatgcctatccaaaaataacttgcggctggataggtaatggatttataatcccggccacaaaacctgtcccgcaaatagttgacgcggttagcgggtattccatgcaacacgccaagctgggtggaaagagtgcaagaacgaagatgatccgaagcctcacaccacgtggctgggcaaaagccgtattcttagcaaacgagcctgtagtaaggagcagaattaatgggaagtaaatttatggcatctgcatacaaccgtttcggtgagccaaacccgaaagcaactaagtataaaagtgggggaagtgtgaaacgagactatcgtgatgaaaaagaggttgaaactgtagagactgttttagaaaatactaaaattgtccctgttccacaacaaaatatcggtctgatggctgcacaatattttggtgtgcgatcagcattgtctcaagaagacggtgtgacagttactgcaacatatttcccatattacgaccgctacggaaatctgtcaggtttcaaaaagcgtgactggacgattcctaaagagcaaaggggccatttctcagttgttggcatagtaaaggctaactcccagatgtttggtcaaaagctgtgtgcatcttccaacaaccgtaagcagattaatgtttgtgagggagaaggtgatgttattgcagcatggcaggctgcatatcaaatacaagtaaaagggattctcaccaacgctaaagccccggcaaaggtgaaacagtgggctaaagaggtccaggacgggatcgatgcagttatcaacgggggtgatttggcaggaaaaccctgcctgccttttgttggaattaactgtggatgtgcaaacgcagtagatacttttgcaaacaatgagaaatttatccgtagctacggaacagtggtccttgcaatggacaacgatgcggctaacgaggtagagaagcaaaaacacgttatcaaaggtgttgaagccacacataatattgcagcatttttgatggctgacaacgtttaccacgtggaatatcctggcgaggtaaacgaccctgatggtgtaaaagatatccgtgacatgctgaaggctaaaaagctggaagatattgtaaacatgttccggcatcctgttaagtatgtgcctgatgctgtgtcggatttagaagacttctctatcgaatctttgcggaaaaagacttccaacggggtagatatcagcgcagagtttccaaaactgcaaaaaatgctaaaaggcttgcacaaagggacactcgtaatgcttacaggtccatcagggggtggtaaaacaactgtagccaaaaaactggaacactgtattgcaagatacctaatggacccgacatgtccaaaggccgatgactacgaagaggatgatcgtctatgcatgattcatcttgaggaggacccagaggaagcaattaactccttgtatgcaaaccagttagggtttgatgttaaagagtttgttgaagatcctagccagtttttaactgatcaagaacatgcagagattcaccaatcatgggcaaaagctggaaaaatcaaagtgttcaaacatttcgggtctattccagtggacgagttgattaccaagcttaagcaaatggtctgcctgtaccattgtcgctatattgtgctggatcacctgtctatggtaatttcagggcttaatgttaaagatgagcgaaaagaactggacatggctatgactcagctggctgcgttttgtaagcagtttaacgtgtttatcttggtgatcgctcacctcaaacgtacagagattgtgcctcctaaggacaaggatggtaacccattacctttctggtatcctgtgcgaaaagagaatttgcgaggatcggctgggcttgaacagttgagttgggtagtcataggtgtcgaggccgaagaaatggtggatcgttctcgtgggcgtgtccgtctggtaggtcttaaaaaccgtccagcaaaaactttaggtattgctgacactttagttatggacccacatacaggtaagttccatgatgccagtaattggtactgggacaaagaaatgcagatgtttacagacggagaaggtggggaggttgtttggagacctcaggccatgtttgaggaccaagagcatgcagttgtagaaacacctatgggcaaggttgtagccgataaggttgtaactcctactattaagcctgttgacacgcaggaagacctccagtacgatgatccatcctctgatccggtccccggttttgaggatgatgaaacacctttttaatgtttaacaaagggtgggaggggtagtacaaccgcctcccctttaaggagaactgtatatgagcatgtggtcgttcgactttgagtcatccggtttgctggaagacccagatctttattatcactgcggcctgtttaaagagctgaataagaaccgttttatgctgttccttcctctaaatgaccgcacacactactccgaggaggatatagaaaaggctaagaacttcattctggcaaagaaaactctttataaagattttgaagttcgcatagcagatttttcagagttggaaggttggcttacaggaaattctgactggtcaccaacagctttgaactgccataactgctacagttatgactttatgctgatggaaagattatctggtattcattttgatatgttccgtgatcctaaatgtatggggactatcaacgatcaccaggttaacctgtttgatacgttggcgatgagccgaatcttgtggcctgatcgccctttaccaaaaggttgtccggactctgtattcaacccggttactaagaaaatgcagcctgttggtcctcacggccttatggcatggggctacgctcttggtaaccagaaagttcaaattgatgactggcgcgatcttccgttatggaagtatgtggatcgtgtatttgaggacgttatcatccaggagctgctctggaaagagctggtagcggaatcaaaaggtgtattctacggcaaatctgacatgcagaactttatgtacgatcctgccaaagagaagccgaaagggttcaagaagatcacctggaagaacgcattacgtcgaggcatgttgcagcacttcctgatggagctgcaggcccgtcagggtgtatacttcgacatagatggagctattgctttacgtgaccgttgcgatgcgtggatgaaagaaatcgctgatcgtgttgaaccacaactgcctttaaaagagctgtcaatgtctcagcggcccaagttccctgaaaagccgtttaaccaagatgggacaatctctaataatggttggaaatggttaaaagataagcttggctatcctgtggacatgagtgctttagagttcaaagccccacctaagcgagcatttacctctacaggagatgtcagtaagatggggataaaatggtgtgaagagatgggctgcaaagaccacgataagatggctgatttcttgagaggctatattaagggcacctccacaccacaacctttacctaaagagctgatggatcaggcaataagcgatctgcagcagaagcgaatgcctgactgcaagatacctatgaaaatcagcaatcaggacgatattaagcgatacctgatcagtgctggttggcttccgacaatgtggagaactaaggatgtaactaaagacagcaagaagaaagctttacctgatgcagatgttgatgcacgagtatatgcatatatggacgagcttttggagtcagagtattgtgacctaattatcaacttctggaacaaaactgatgctaagttccagacaaccgtgcacaagttccgaagatttcctaactccgaaaggattaaaaaggaagtattcgggaaaatacgtagaaaagctagggcacttattacttctccgcaactgaaagatacgtttggacacctgtgtccgaatcttgaaaaattgaacggagagatggctaaagatatcgtcttgtggttatcattgcgaaaccgcagatcggtccttgatccaatcaaggaggataaggttgatactggtcttcttaatcacccacgtttgaagattgaccataagcttcctgctaaaagctctggattaacaaacacttcccgacagaaacacagtatttgtgcaaacatgcctaaaccatctcctaaagtggttatgggtaaagagatgcgtagcttgtggggtgttcctcctggatattttgagatcggtattgacgggtccaacttagagcagcttatcggggcttggggtgcctttgagttcgacaacggcttgtactatgatgttgtaagtaacggagacgcacaccaaaacaatgctgaggcatatacaaaagtagcaggcaaagaggtgtctcgtaacgacggtaaacctatcacgtatggggttatgtacggggcacaaaaagataaagttgcagatatgctggatatctccccagagttggggcaaagggtgatcgatgcactttgggatgccaaccccggtcttaaggggcgcaaagaggatctggagaaattctgggaagcaacaggtaagaagtttatctactcttttgatggtcatgctatctggacccgatctaaacactctttacttaatgcataccaacaaaatggtggtgcatcgctgtgtgacttagttgggatactcatgcaccaccaaatggtgaagcgtgggtggtacgatgaaggtgtccgtcgtattatttattaccatgatgagtaccaacttcaggtccctgacacacctaagtataagactgtgtacaccttcgacacaattgaagaattggaagcatttaaggcagagcaggaggccaaacttcatgtgttcgacggtcataagtacaaaaaggcacgcaaggatgaaaacggaaacgaagtggttgacagagacggaaacacggtgtacgatcctatcctgaacgatgacggaaagcttgaacttatctggagccctgtgggtgaaatggtggtgcattgcttctggcaagcttctaaaatgatgggcgttccattccagatcacaggtgaatacttgtgcggtcgtaactggggtgattgtcactaatgtaaactatcagcacagggaggtgctgttgagcaaagaggagacttttatggtagtagagccaacaaaaacatttacatccatgaccattcctgttattatgcaggtggagtgtgttcaggtatctcaagtgtggcctggcaccaaaatcccaacagggcctgatttctttcaggttgggaaagtgtacaatgtctggaaggcaccagattgttaccctttcattaaagatgaccgtgggatgctgtggtatcttggaaatgacttgacactgcaccttgggaatgctattattgcagtattcagacttaacaagaaggagaccgatcaatgacgactttggttaaagctacctttgtagaagaaaagatgacagacctgtcattctttaaagaaggaaagacctacgaggtttattacgataaagctcgtgcaaacaaaatgattaaagacgaggaaggggttgcctggtatatctctcacctggcaaacggtgagtatcatatctacggaaccactttgcttgccaagtttgtagttgttgaagaggacctatgaaagtaaagtatcttgctgaaggtatgaataggtattttacccttggtgaagaatattggccctttacaaacaacggtgatgtctacgtgaaagataatttcggcacgccgtggtttctgcactctaatgggctgggatactccatttactgcggtgcagtgaacaacacaactcttgcagagttcgtttagaggaggtaggatgttagtaaaaggtacccacacagtcaaacaacgtattgaagttgagattgatgattgtgagctgaagcatattttacggtcatgctccaacgttttgctccttagtattctccaggagcgagcggagaacgagttcttaaatgcactggcaggccgccctggtgatttctgtgtgcgtaagcgtggtgacaacaagtcatggctgtgggagatagacgcagaatgggattaccataaaaatgagggtatagatgaacctattcgtgaattgacggacaacgaggttcagatgtacaatgaagtttgtcagtgggcaaaaagtcaacaaacttatcttgatccttggtggatgatcgaaaatagtcgttgacaggaagtaagattagatataagatgcttcacacaaacagagcgttgattgtttaacacttaaggagaccgctaagatgaaaattactctgaagccagaatgcgttgaaaatgaccgagcttttaaagattgcacaatcggtgcaatttatgaagcagagttttgtgagaaccctttggtaaaagcccttctggaagaaggagctcctctatcacaggaagagcttgatgagttggaaaactcagcacagtgccttacctttaaagatgatgaaggagactctgtctggtgcactgttaatgaagtagtttttgtaaaacctgaacattaatgcttgacaacagtcatagggcctactataatggccctatcaaaacgaaaggggaccacagcaatgaccaaacaatatcaacgaattaaagccaaggttaagccagactatctggagaaggactctgcttttcgggactgcacagctgacaaagtttacacaggggccgtcctgttgaacgatgaacttgaagtagatattctgggtaaagaggccactattaaggacgaccaaggcgattatgtttgctgcaccacacgtgagctagaaatcttagaatacttcggtgaaatcttcacctctcttgatgattacttagatgatgaggaagcgtgatgaaaaatatttgggatatcgatatctttgaagcctctaagcttgatggtgctgatggagtgattatggtgtctgatggcaaggcaacactaacttccggagatatcatctatgccttggacgagctggcgcttctgaaatctaccggtaacactttagaggagcgtcttcaaggcttcgccttcaaagaaggcacaaataccgccatgatgtgcaccacacggacagttcaagttggtaacggtgtctatatgatcattgctgtgtgtcctaaattcagcaacgtcaacaaagatgatgctgacgctgtcaacgatgtggttgttctcttcgtgggtgacgctatggcagatctgatgaatgcaggagaagcagcaaatgaagactgaaaacatcacccccgcagggttcttaaaagtataccgtgaactgctatatactacagaggacagtgttctagagtatccagaatatcttttgctgtataagtatctgcaggaggctggtgaaaatctgccagttagtgcagaaggtggtccgaactggatatacagcgcatggagaaaggttgacattctccccgacccaggtaaagatatggtagtttggcagcttattaacaacatcgggattccaatctttgatgaagctgttaaaatctattttgaacttgacgattaatatcaggagaccttaagatgactgaagtagttgctcgcgcaggacagaaagtacgttgtgttgaagtaggttttggtggcaaagggtgtcaaaacttgactcaaggtaaggaatacgctgttatttctggtggtggcgacgaaagtattgtgttcgagggccacatcctggatgctgaaaactttgaaatctttgacgacgatggggatccgatcacctgcctgctggacgggaattggggaactttcgaagtgattggctaacaaatacctattgtaatttacagaaggggatgctaaaatagtgtctccttctatgttgttcaaataaaatcggagattccataatggaacaaatgaacgatcaagcgtcggttgcgatgaacgagcaagaacaacctcaagaatttttcttagggttaagtaaagatcaagtgtctcttttgctagtgctttcttctttcatgggaagacttcaggagctcacacaacaaccggaggctgaacaattatttcaggctctgcgtgaagaagaaaaatatcgtcgtttggactatgccttaggttgggtagctcaacaacgagatatgctgatggccctctctgggaccacaagttttgcaatgggcctgttggctcaagttcaggacaaattaattcaagcagggtttgcacacacggcaaacactaacgaagaacaaggagacaaataatgagcgttattcaacaattcgctaacccgatgaatccgcgtgaaactgttttactggctcacggcatgattaaacgcgtcagcatcaagcctatcaaaggtgctgatcctacaacaggtattaaaaccactgtgtggcaaggtaagaaaattgagtccagccacaccatctctttactgatttctgaactggattcctctgataacctgcttcaaggtggtgaagaagtctggatcagcatgggtgataaactgcttaaaccgggtcatcaagactctgtctctgttaagattgatgacaagtgggaaaccgtaacgccaggatggatcgtaaatatccctttgaaggcaaacgagcataacggtaagacctactacaaaggctcactggctaagatggttaagctgggcgcaggagaggctccagcagcgactcagcagcaaaaacagcaacaaggtgcacaatcacaaggccagaagcagaaacctcagcagaatgccaatcaggacgttttacgcatctatggtgatgtgactcagattgttggcaacgtggttactgtaaatgaccacaagattggcgaaggtgctatggttgtaactgatgagcagcttaaagacctggtggtaggcggtcgtgttgcagccattgtggacaaagacaccggaaacattatcagtggtttcaaagcctacccacctaaggcagagaacggcactcaaggccctggtggcaagcgtaaatcctcttacgaccctattggtgtggagacggggcatagcatcaatgcgttgcagatcatcctggatcgtgggtttaaggtagacgacccactaggcgtggctaaaacactgcacgtagtcaccatcgagcttaagaaagagtatgctcaagccaccaaccgaactgaagatgaagtaggtgccagtgtcggtaatgcggtgttgaacgcttgtcgccgtattgacaagaaaacgaaagttgatgattttgcagcggcaattactgcagaagcaaaagatgttttgactaatctggctgagccgttgtacgattggatcaagaacggtgctgagtccactgaccatcaagaacctcaagctgccaaacaggaagccgctccacagcaaaacactgtagacgcccctcctgtaaatgatgaggaagatgacccgatggatcagaatccagcacagtacgcctttgatgatgacatccctttttaacatctagtcaacatggccctgcccgaaagggtggggcatttttgtataaggagatctgaaaaatgacattagaagatatcattgttaagcctgagaactatgaccaatacaacctgtcaactcaatctgtagaccttggatgcgccacggtcagtgcgtggctggttaacggaaaagagttggataaatgcttggaagcccacatgtctgttaacaagttcctggatgaaaacactcactggcttgagggtgcaggcgtatatgcttcatggttggagagtatgggattcgactaccaatctgaagaggggtggtggagctatttagctatctgcccagagacgctacaatgtttcatgaaatattctgaagatttggagtaccgggcggtggttgatagtgctattgcccgttatagccgtaaacctttttcccacgacattaaaactgtggaagaatttgttgaagttttctgttgacacggattgaaaggtgtgcaattataacttcatagaacgggaggacgtgatgaacgaagaaaactgggatgtataactaacaggaggccactgcccatgatttatcgaatccgtgtaagagaagatgcaccaggctgttactttgactggcgtgggtggtggtttctccacccgatggatggactcacagatagaatgctggatgctgccctttatacagataccgatatagaatataatctctatctgaaggacggtatagataacggtctatttgaagcaattcctgtgtaagagactgtgatagccatgttttatgatcttcctgtagcaccaccacctgttgaacccggagaactaagatgatctatgaaatgccaaaactgattcgtgacgatgcccaaaacgctcacaccattattatgggcaaacgcatggatattatttgtcataaagatttctgggaaggaagttacttcacagagtattttggtaaactggacaatggtctgctgatccagttctacaccgatgcggaaaacaacattcactgggagttcgaaactgaagatatccataaacttttcaccttcctcggtattaaggttgaggccaagtttgaagaaggtgagtgcgacgattgtggattctatgaggtaacagatttctaccttccaagtggtaaaaatctctactacgaaagccacttcggcaactcaaatatgccacagggttgggatgagtttttggaaattgcagaagaggagctggaataccgtgattattgatactgtaaagggagatctaatctccattttcaagaaagggtcaggccacatgatccacggttgtaactgctttcacacaatgggtgcaggtatagcgaaagatattgcccgtgagttccctcaagcactggcagccgacaaagagactgcttatggtaatctagacaagctgggtatgttttcttgttgggagcattttgccaaggccagggtcgtatatggaatcaacctgtatacccagttctacccagggcccaatgctgaatacttctcaatcatgaaaggttttgagcgagtcaacgaggtattcaaaggtatgtcattgccgttctacattcctaaaatcggatgcggtattggaggtctaaagtgggaacatgtagaagatgtaattaatcttgcaaccacagatattgatgtggttgtagtagagtacaaaaagtgttgacgaccatcttctgaggtgatatagtttccacaacaactaagagaggagagcactgtggagactaaaatcttaattcttgctgtggtagatacaaccgaaggagctatattcgaatctgcaggagggtatttctacctaccatacggaaaaagaacttccgagccaagtaaagattcaatcctcaaagtgttcccgtgtgctttctggctggagattttggtataagattgcagatgatttgggagagaattatgagaaacaagaaagaactttactctggtgagtggatcaacgatcaacaggtgggagaggtaacctgcttccgatgttttaccaggtacaatcttaaaactgcaccaaaaagtgttccaaagactgatggttattatataaaagaaccccattgcccaaaatgtaaatgccgattgtactggagcaatctgtaagaggttgacatctgaaaactgcagtgtataatatacgcataaactaacagagagcgatgtattatggtaatttttaaccgagatggtatcatagttagacagcacccgttccttgaatactatcaaattgagcaatggtgctacggggattgcagtcactcctatgggcaaagttggggataccgtacagtttttgaatccacagaccttgacaaagtaagacagaaagttttagaacttattaacaacaagtgagtatgatatggtaacattggaaagacgtaaagctatcgccgccacactggcagacatcttttgggattgcaacttaaaagataccagaaattgtggcgcatctgtagatgtattattctcacggcccaccattgttgcaatgggaaacctgttaaacgtagtgtacggagcatgggataaagagggtggattttacatctggcaacctgactacgggacctggaaagaggtaaggggtgcggatgactttgggcctgcagctgctaagatggatggctggcaaatttatgttggaaacgacatgaagctgaaaggcgagattgtttactggttaccttaagagaatgcaggagataaagtatgaacaaagggtggacatttgtagacggcgttaaaaacatgcctctagggaagtatattgtagccatggcagatgagaatggcaaggtggatttcggagtttgcgaggttgttcttgcaggatctggtgactatgctcacaaaactgggataattaacggtcatttctactttgattacaaccctgttgtggcgtatatggctatgccagagttagagctcccaaaggagggtgcagatgtttaagcttaaatctgcatggaacatcgctgtggggggacgagatccgcatcccaggtggaaagaccattatgaagatatcacgtatcgagtatgaaggtgatcgtgtatttcatatctttgcagaagatggtcgagaaatttatatacaggtaggctctcacatctatatccgtaagaaaggggacgacaaatgacagagatcatcgtttcaactgcagggtatgtattcctgacaatcattgcgttggctattctggtggcggtgtatggatttgttatcctgcctattcttgagacatttagtttgtgtcggtgttggagaaaagcttacggaccacaaccgtggaaagactggttccatttggtgcgtatagcgttctcttatgcctatgaccactctagcagtgcatgcgtaaccgggtaccatgcctacaactggaactgggaagggctggggagatggactgttacaaaaactatacccttacggttgtataaaggaaagaacaaactgggcacctgatatttttaagttatcaggttgctagagatcaggaggatttctaaaatggatttcctccttttgatatttcaccggaccagatattttaaaattcttagaaaatcagaaaatggatcgaaaactaaaatggatttttcagagtaggcgcgacaagctgaatcgctcatcctatcgtttgcaccatattctagaccaccattacagatttcccgcacatgctcacatccttctactagaacttcctccacttacccttgactttttatggtaatagtctaaccactatcttgaggttgcggtacagctttccgggtactcgatctgtttttcgtttcaaagattgaattttctgaaaatttttctcgataaatttctcagtactcgatctgtttttcgttttctgaatcggattttctggaaatcgttccggagctcgacctgaaatttttggggacgaaatcgatttttcgttttcagaaatggatttttaaaatttctatataggaatattttagtggatactattttataggaaattgttacggagggtaattagcgtgctaattaaatttattaaatgtgaggagttctcatttagaattttgaatgataatcattctcgtttgcagaataacgggcaggcccggtgattgtctcccggcccctgttgccccggcttgttattatagtatcacgcaggacaaagaaagcaaggattttttgcataaatttttagacgataatgataaccgttctcattctatctagcgcccatccccggtgattgtctcccccgtcaccagggcctgccgtcctttcgatgtaaacattataccgcctggtaggaccgctgtcaacaactttttcaaaacgttttctaacctggctgggccagcctggcggggcctgactaaccggaacaaggaaagggtgtaagcttgtaaacttggtagatttgtgctatagagtaagtaacaactggagaggagatagaaaaatgaaaggcaatattattcccctggaaaatgtagaggttaatgatgtggaagctatcgccctggtagagaaagctaaaactgaagcgttgaaacataaagatgagtacgaaaaaatgatggttaacctggcaggtgcggcggcaggtgaattctatcttaaaaataatttaaaataagtgttgacaacttggttaatcccggtattcttaccgccataaggtgaacaacaccgctacactatcagagaggaaaacattatgaaaacttacggtatcgctacacgtcgcaacgttcgccgggtagtcactgatcaaatggtttgccaggtagacgtaaccatcaataacgggcaaggcctttataaattccgtcgcggtcatagctataccctgcaacaacttaaccgttgctctttaacgagaggtcagatcaaccactggtttaataaaaaataagtattgacatatagtctgacaccaaatacactaaaagcacaaaagacactaagaggataaaatcatgaaaaccactacctttaattttgataatgcagacttttctttttctgatgtcaagaactgccgccgtgatcgtggattttacaaggcttataatctggttggcctggacgatgataataatttgcacgaagtagcggagatccggtactatgccgccgccagcggtaacactaactattgtgtattttggattcacgacaacaagaacaataagtacggttatactggcggcaaggcgagcggtcacggttatgataaagccaacgctgcacttgaaagcgcattaaatgccatgggaatcactgctaacggctggatctatgaagaagaatttttggcggcacttgctaaccaccttggctataaaaagcacattgtaacatgcgcccacgaataaaaattgttgacacgctgcaaaattcaagtaaactagtcacaaaaggcgggaatgtttcccgccaacacaaaggaaaaagatcatgaataagaacgtacgccgcatcatgaatgaactggcaaacgatgaaaaaattattgacatgcatttgatcaacatttgccgccgttgtgtaacatataacaaccgcgccgcaaaagcgcgtgagatgaacgcaaaaggcaccttaaagccattccaggtggtggtaaaggccattaaagatgtaactaatatggcaaaccaggtacaggggagcaccaacgagagtaccaatattgatccggcttacatcatgaaacggatccggacctgcaagaacaaagagcaagtgtataatgtcatagactggttggattctatgggcgatgtggtgtacaatagattctcggcagctattgagatccagcttgacaggttagacggtaaagtacttaaaacttactaaatttatttttagatggccttgactccagggccatcaataaagtaaattaatctcagctaagcgaaaaagggggctttaagatgagcactacacgccaatacacaaaggtaactattatcgcctgcgttgtcggttacatcctggcgcaaattttaatgagtagcgctaacatttttgcaaaatttttcttaaatttttaattgacaagctaacttagattgatatacttaaacacgtaaacgggaaaacttcccagaacacacaaaaggagaaaacaccatgactactatgaccgccgcagaaaaagctattcagatcgccgcactgaaaaaacagatcgcagaccttgagaacaagatcgataactttgaaatcgacgaggacaagtacgacgaaaactatgatgaatggttagacgagatctacggcgaaattatgatcggaaacatttcttttcttccgtcgcgtatcctcaaggagctagatcctatcgcttaccgctgcggatttagcgactacatcgacagcctggatattgaggacgatgaagaataccaggaattacagacagagttggaagaagtaaaagaagagcttgcggagctggaagaaaacgagtaagattatttttagatggccttgactctagggccatcaataaagtaaactttatactgttaacactgaactaatgcataggagttaaaaccatggcagcactaatcaccaaatattatgcccctaccaacaccaaaagcgcccgtatcatggtaaaaggcttcggacgtaaaaaggtgtacacctgggattatgccttagacacggaagacaactacaccaacgcaatgaccgattttattaatgaactaaataagcagatcttgacaagttataaagtgacagatattgcttatataggtgaaggcgggatctgttttgtaggcattgtgaaatagttattttttcggtggtcctggttgcagggccatctataaagataatttattaacaccatgaaaggagaaagtacatgattagcggggctagttttatcattggcgctattgctacggctttaattgtaaacaagatccaatctaaaaacgaaaaagatagcaacgcgctcacagaatacccattttgggcattcaacgacaacgaagactacataatcaagtacaaggatgagagaggcgaccaggtaacaccgcgaccgatcccagcttacaagatgcaagaaacactataccgcctaaaggctggaggcgcaaaaatcgtagacttttggggatatgattgcaaggatcaggaggttataaaacggcgtatccgggctattcaggccaatattgaagttagcaaggggggaatatatgaagattaattttgagaagattgtaaagcgatctcatgattccgaagagctgccggaacgacgccagcgtaacaataaactgaataagccaaaaagatttggaaagatctggcgaaatcattatgatcgtaaattgcctggcctacttttggaacgtgaacgacaggcagaacgataccgccataaagacaaataacaaccaacgccccgccattgtgcggggctttttatttctatcctacgaatagcgcccctggttggccctgtaagcgccaaaaaggccccacctatgcaatcgccaccctttaacctgaaaacatcgcttagggccgttttatggcgttaaaaatatcattgacagtgattttatttaaagcttgacatcttaaacaggttagctatactaaccacatcaaagagagaaaggagtaaacgccatgcgtaaattaaaaaattttgataaagttgatgttgtcctgaataatttttactactgcaacaacaaggccatttggtggcgtgatagttccaccgataaagtcaaggcgcgctttctccaggggcactggcaaggccgcccagtgattaaaatcatggggcaattggtagcgtttaaaaattgccgccgtgttgatgacgttgaagagattctaaacattttacgccacaataatttaaaaaatagtgttgacaagtaagcctcaataagtatacttaaacacacaggcgggaaaacttcccgccactaacaaagaaaataggagaaaatatcatgactaccgttaacattaccacaggttgcaatttatctttcgacgtgctgaccgacgaacaaaaagaaaaagctattgaaatggtccgcgaaagagaagaacacagcggagaggattttttcgcagaaagtgtaattgaatattataaagaacaagtttttccagagtacggccttgaagataccgatgtacattggtccggcttttggtgtcaaggcgatggcgcgtcaattagtgctgaaaacgtggatttagaaaaattcttgcgtaaagtcaaggccctgaccaagttccgatcaattcgtcacttgttcggcacaatgcacgatggcgaactatcagccagtgttgaacgcgacaagtacagccattacagccatgaaaacactgtaagcggatatattgatactacctggctagatctgaccgcaaaacaagaaaataaagtggaagatctggaagagctgatcaccgagacggtacgggagctatcccgcaaggtttatgtagaccttgaggaggcctatcttgaacagtttactaccgaaaacctgatcggccttattgaagccaatgattggcggtttgatgtagatgaatatggtgagatgagtttttcataaataaagtgttgcaataatttaaaaacctgctatattaaaactcaaggggcgagatgacttgccccacacaaaacaaagaggaaaacatcatgaaaaacactactaaagctattgacaccgttatgtttaacctggttacattccgtgaagatatgaaagatcttccacgtgaaacagtgtgcgaccatatcgaaaactatcgcaaacttattaaagaattgccattaaaacgagatcagtacgcggctaacgctatgcttaacgccatgatcaaaaagatgatccagtgtgatttaactctggcctatgattatgcaggcggtcgttttgcagtatacaatcagcccgtgcccggtatgagcaccaccgaagaattgcacgcgttaaatctgaaacaagatgtatgggataacatgccccgcgtggtggtgtgggcagaaagcgggaagatttacggcgataatttttaatcaggtaacaggcggcatatttgccgccttattgttaaacagaactgcaaaagaggtacatagaatggaatttattattttggctgtagtagttgccttgttcaacgcctggatcgctggcaagatgggtagatccgcctttttatggtttattatatctattttcctgggggtggttgcaactattgtacttgttatccttgcaattgttgacaaaggcgataatagaaagggtaaagtattttccgacctgtatgacgcgcaaacgtttgtcaacgcctattatagtgatcttccagtctccctacgctgcagcctggcgcaacaggtttttgatgaagctaaaaccagagatcaagcccatgagatatgtttaactgaggcggatcgcctatttgagaggaatagaaaatatgtgggccagccgtttaaataataccacgttaattaatccctttaatgaagatttgaagccagccgcctggcgtgatggattcaataccgaacgctttattttcaggcctgatcttgaggaattttataacaatggatcgaacaacgacagagataatttttcttgtgatgtgcgtagtgatggtactcctgggggccattgtaaaccacgtcactactaccaggaggaaagggggagacgatgacacccaaggataagccacgcaccgataaggcgcgccgtgttatggtgtggctggagatcatcgcccttgaaatattgttaggcgtagggatgtactttatcgctgtaagtaactaagaacggcccccgatcatgggggcttatctttttaaaaaatttttcttccagggtgttgcaatccggtccggaatgtggataatgacaatcaacggggagctaatccccaccaacacaaaaaccagaaaggagaaacaaaatgagcaacaatatccgcgttattaacttcaaaaaagaagaaaaaattgccgtgctgattgacggtcaagaaatcttcaagggcgattatgaagatcatcaaacggcgattagtatcactcgcgtgatcggttaccataatttctacccccaaggcgctgaggcagcagttaaacgaatcaaagagattgtaggcctgtaaaatttatttttagatggccttgacttcagggccatcaataaagtaaatttaaaccctgttaaaatactacgcagttaacaaggagtgatagacatgtttatccaggctaataatctttatttctttgatggtcagatcgtagatggtgtggaagtggagatcaccgggtgccctggcggtcaggctatgacttttcggaataatgcctttgatgattctcatatcgttatgagaatggaagttacgaagctggacgacaagaaaacacttattgactattctgtgaaagatcatccagactaccgcatgatccatggcgatttgtgcattgttgaccgtgacaaggtgggcggcattgtgatcgctattgtgaacgatgttttctcaaactaatttcagcaggtgattttatgaaagtaaaactatattaccttaatgagcttaacccccttgcccaggtccgcgccctagctaataccttgatttgtgagaaatctgtatattgtgttgagcttaacgccatgcgtgaacgtctcaaaggtggttactttgacatccatgctgcaatcaacggcctgaatatggaatttatccgcttacgtaacagcagccggaatctggcaagaatggaacaagatccggcccaccttcgtaagctggttattgaaaatcatctgatgttcaatgccgagggtgattattaccattttcaccgcaaacgttggtaccgtggcggcaatacaagcaagaatgcaaaataaggcccctggcagggcctgcagcgatataatcacataaaggctatgcggttgcatggcctttattattttagcgttacagcgacccccaaggcgcttaaaaaaatttttaaagaagtacttgcatcaagccctacaatatggataataggacgtgtcgggggggcggcccccaatcattaaccggatagataggagttaaaatcatggctattgttaccgttggcgatgtagtagaaatggaagcaaaatacttaaaagctggtatgcatatcctacggaatgatcaagagttattattaacgatggtcgactataatcccggccaggattatccaagcatcgactacttttttgagtatgttgatgaagagttgaaagaggatgaggcctattgcggtgagttctgcaacttcttttgtcctgacgaggttgtaaaggttatttatcaacctggtgtacctttcccgctgcacgctatcaataaataaacctggcggggccgaaaaggccccccccaattatgaaaataaagagaggcaaatcatcatgatggaacaaattaaacgcgccgaggctattaatggcaacgtgatctattttgtcagcaaaaacgaaaaaggcgtaccctatgcggcggtaatagtacagcctggcggcgattattggtgcactgtgtacggcgcttattcttttgggcgtccagtgcatgataaaattttgaaagtagcgaaccccaccgggaaaaatattacagcagaaaaattttttgaaaatagttgacatgaccttataagactgtagtatataaatcaaaggggcaagccccaccaacagcaaagaggataaaaataatggctattattgcaaagactgagatcgtaggcttggattctattctcctcgcatatgaggaagctatagaaatgtatgtggtttcctatggtgagtatatccgtgaatataaatctattgatctggcttttgaatgttatattcgccaggttaataaagcgtacgatgattatcgttaaaatagtttgaaaacaaacaaccatcttacaaagcataatacataaggcggtggaatggtccgccacctggaacaagaagaggaaaacaaaatgaaacagaaattaattgatgcggtgatcctggttattgccctgggtattggcctgattgcaaccatggctaatgtgatcttgtcttccaacggtatcgggtgaggttggcaaatgatcactaacaaaacaggcaaaacagaatttttacgcaacttacagatcggcaagcctgagatctggcattgcactaaaacaccacgtgacgaaatgaaagacttcaccgccacgctgcaacgggtaaagatatccatcacgcagaaaaaggccttgatagtggtggaaggtgagatccctcaaaccgttgttatagttgagcgtacagcatagtttaatttatagcgatacctgaaaattaaccaataaatcataaacaggcggttaccgccgccttaaacgtagcagaaagaggctagacacaatgaaaaagatgatcgcagtagttgccctagttgttggacttaatgcgcctgtaatggctaaagagctggcaaaagaggttaatctaacggatatccatgccgtcaatcaaatcggggttacttatcgcttatgccttgccgctaaaacttttaatgacggcacgacagagtactacggattcgagggtatccggtgcggtgagcttgctcgcgaccttaaggaagatccagacctggaagatctgcccatcaccgtaaacggtaaagcttacgtaaaccgttaaccatgagaaagataatcatcaccttggggattgtggcgggatcgctggcgctctttccccttatggttaggtatgtgctgatcagtattgtcctggtagtcagtgatctattggaaacggttggcaccttgttttaaagagcggtaaaaaaaaatgaatgtcgaacaagttagaaaggtattggcggtactgcgttatcataatcatagaaaggtcatagacgatcctgattatgtcgattcaaacctggaagaggatacactacaagccataagtaacatgcaagaattgctaaagcgcatgacagagaaaaaccgaccggactacataggcgaaaaaatataatatttataaactacaaaacagggcttgcaatggtcctgttttttgttatacttattccacggcaggcacctggcgacggggggagacaatcaccgggcctgcctgtcatataagaactataaaaaccgttgacatctgccatggggtggggtaacatttatcttgaaggggcaaaagtgcccacacaacacccaggagagaggaaaacattatgtcaagctggattaatcaagaagtcgaatcacgttttaatgctatatgggatctcatcgaaaaagaggacggaacatcaagcccctacctcaacaatttggaattccattttgtggaagcgatgaacgcagaacatgatcacgaaggtggcgcggatgagttcgctaaaggttatggctttaacaatgccaacgaaatgatcgaggcggtagtactccaggctgaggaagattatcaattaaaaacgcttgaattctgccgccgtaagtaataagataatgacacgggccaaaaggcccactaatcagaaccacacaaagagagaaagaaaatgacaacccgtaaaattaaagttgtttgcattgaatcgactgggggcgcttttgtagttggtcaggaatataatgcggttttaatgggtacggattggaaggttaaaggccttaatggttacgagtacggcactacttgcggcttgcgtggtcgaatcggatacgtgagtttagacaataaagaaaaatttgttttcgacacccttgtgagtaaatagcatgaattgctaaagactgatctgcgaactgctgtattatcaactaatcaaaacgaaccacataaagaggaaacatcatgaaacgtctggatcagcttaaattagttcagtacatggcctacagaattcttgaagtccaaaaaggtagcaaaaaagaggtttgcgagaaagcttataagatctttacccgcaaaaaagatgactggatgctacgccagaccaaaaaggctgacatcttggggtacctggaagaagagatccgccttgaagagcaagaagagatccgccgtagtgaggcagattatcaggcagcttgggaaagctggatgagtaacaaataatacaacaagttacggtcagggggtaataaagcccctttgatcacataaaaattatgctatccttggttgacatggatcggcagttttgctatattcttttttgaagggcggttgtaagaaaattaactaagaggtaaaaacaccatgaacattaaatctaataatccggcatatagctttgataacgctttttgtcacggtccggcggcgaaaggattcgaaatcgatggtaaactaattattgtcaatgttgacggggaagaggttgcagtatatccggtggcagacgttaaaagccgtttgcaatgccgcatggatgttaccgcctatcagcttgatccggtccgcatagttgccctggtcctggaagaagaaattaaagccatgcaccatagcaacaggtttattggtgacgctcaggataatatgaaagtatgccgccataaagttaatgaagtgcttaaagagtacggctataaattatgatcaaacgtgaggaaaaattccgctaccgtaacgacctggcaaatcggatttttgaaatatacgaatcattataatttttaactgaattatcaaggggcttaggcccctttctttttgtctgctcttctccctaccataaacggccctacctggcaagtggaataattgacgagccatcaatcccacacactgtacaaatatacatgtaaaatagctattgcataacctttcattgtgtggtagcagggctatttttacccgttttcccttccaaaattgcacgtaatgccgctattgcacaaattttaacctgatgcagatcttcaatatcttgtcaacaaataaaaattcttataagtcatacacttacacaaactaaaaagcgtgttctacgtgaaaaatcgagtataactatagccgccagatctcagaatttacgtacgctcaccattctatagtctgctaagcatttattccaaccatagaataatggaatagtcaatacctgcataaaattattattcgtttaaattgcataacataaatcggcttaggtgtcaacatttttcgtaaacagtcagaaattgtcacggtgagttatcataaacagagaaatatttagtcgtctaatgtttactgtacattactatactaactgaaatcattagatgactaatagaaagataagaaataattaacaatacaattattttatctgtaacaataaggcaactatgcaaacgaatggcatgtcgcgacggagtcgcgacataatataaaagcagtaaccatcacccccgtgatagtttgtctgcaaactattaatcagatcatagttgccttgtatttagttaatcatgacatgacaagcaaggcaactatagatctgctaatagttgccctgcttttatattatgtcatagaaacacccgaaggggtgaccaaaggttacctggcatagccagtgaaagattattaacttgctaatctttatcatgcaaacgaatggcatggctgattatcggtgtgtaaacagtcaatcatgtaaatggttagcatgtgaacaatcaggaatgtaaacaatccagtgtgtaaactaataggtgtgtaaaagtgtcatgttgtgtcagttaggtcacattatgtca

SEQ ID NO: 15 - DNA, 70153 bp, artificial sequence
  BP1229
tggtggggctacaccccttacaccataagcacccccccccctgtctttactagcgtagtcttagcctaccccaccttgtacacgttacacgttgcttcgcaacttatggacatgttgtccgtatcttatcaatcaactattggagactaatactatgactactcaggctaacgttcgtatgactgtaggaactctgttgggtactgttaatgaagcagcaactactgtagctgatacattcggtactgctactaaagcagtaggtatgcttaatcgttatgtaactaaacaagcagataaacaaatcattcgtgacaaattagaaatgcatgagttcaccaataaacttattgaagaaactgcaatgcaagaagctattcgtcagaaacaaatcttagacttctgcaaagatgaacaaaacaaagaattgttctctaatgcctatgaccgtcttagcaaaatcttagcagactctaaataataacaaacaaatggaggctcttcggagtctccttttacatagaaccgatagttcaataactatctactttaaagataagaagctccgcttcttttggatgaagtaatgcatccaatcctgtatgaaatcttaaccttttgtctgggattactcaccgacaaagtagtctcaactaatcaaaatcaactatctggagagtacaaaatggctatcactacttttgctaaaacctttggtcaggcttctactaaaactgaatccaacaatggttctcgtccgaaagctcagttctggattaacgttggctatgtagctaatgaaggcactgaagatgaacgtttcatctctctgcctactggtattccactggatactcaggagcatctgccaaccaattcctctaacgaagacttccgtgcaatgcgttgtgcacagaacgatttgttagaccaactgatggaatttgctaagactctggaacctggtcaggaaggggttatctccctgcaagttcaacttcgtcgagttaaagaagaagctcctgctatctcagcaagtgagaataaatatgctcgtaaactgactttctaatctttataggactaccttcgggtagtcctttttaattttaactatctaaatactaaagtagagattttgacccttttcgacgaagggatactaaaaagtaatggatagtttgagcagatgttttagaagaaggagtatacagatgcatcctcttataaaacgattcctgatggactatcaggagtggttagataatggagccagtgaacctcattacctgtttgataggggtagtggactgtgtgttcaactaggcaagtatcttagaagacagccaatcagtgaagaaacagtagatgctctgtgtaagagctttactcatttacttcctgataatgataccaatctaccattcaatgtagatgtcctcgactacatgatggagtgttctgatggaagatgtcatctgaaccaaagtcgaattaattggattaagaaccagttggagagtaagtaaattatgtcatatgaaattgtaaaacattggacttctaaggctggcctgaaggcttgggtattactagtaaatggtggtagtcatcattgtggttatgtagaaataccagaagcattactggataaaaacttctatgactatatctgtgatgatgaagaaacgcttcatattgcagtacatggtggagttacctatcaaggtgtccctcagtggactgatgggattaaagtcataggttatgactgtgctcatgcaggggataaactgaaatgtcctaaacaattcattggctccattagggagaaactctatgaggattcttatggagtatggcgagatgaagaatactgcatcaatgaatgtgaaagcatggcagaccagttaattaacctgataccaaaattagggtttaacgatgaaattcagaacagtaatggttaatgctcttgataccaggggtaatgaaatcattagctataaagtgcaaggctttaaatggttcaaatggaaaacattaactagctttaaagaatttgagaaagataaagctattaagttaaccaagaaattgaaccaacgtaagaagattaaattagttactgtaattaaataaggataaggcaatgcgtaaatcactaatcatgggaaccaaagaagacgttgctaagatgaaagctaaacgtcagatgaataaagcagtaacgtttgcagaacgttatagtacgtctgaaccagtacgtcgtattgttactttcaaccatccagctattaagggtatgtaatgcaaactaaggataaaaaagacttagaacgtcttctccgtgtatatggtgattatgcattgttagcagagataactaatattatcgaagaagactgtcgtaatggttatgccaataacccacaagcaataattcatcgtgatgcagtagtgcttagaggagcagtcagtaagatgcaagcattacacccattaagacaacgagcataaataggagggggctactaagccctcttcttatttttatcgtggttattaagcaactatcttagaggaaggaataatggaacagttaaattacggttataagattaaacgcaatcaagtaagaggttcttggttatttctcatttatggcaaaccaatctatgaattacatcgtggagagaaatccaagacctattacgtaactcatattgctacaggaaagactcctgcatgtgcaggattgcttcgtgatgcaattatgaaagcatgtatgttagaaggacttctatgaaccaaatcattgctatcccgcagcataaagctcgtattgctgacaggaatattcgtattcattatccaatgcctttgagcaatccatttcaaaaaaatgagagaaccacggatgaagatatagcagcagcttatgaggcatatcttcataaccgtttggtaagtggtgacaagctcattacggctgaaatggaacgaattgctaaattcgttatggatgctactgacaaaccagttggcctcatcggtaatgaactggaagtgaatgtaatccgtaagattattatggaggctcttaatgggaatcagtgaaccccaagctatggctattaaacagttagccttcaactgccttagtgctatgaaggcatttaatgaagcaaaaactttccctgaccagaataaagctcgtattcgactttatcagtctaagaaagattttgaagaatatctggaaagtattatggtgaaataatgaaaacaatattaattgttcatgatgctgattttaatgatgttgataaaatgatgcgtaatattgattatatagctcagacaactccagcatttaaagaagaatttattctatattgtgatgctaattcaccattagttcctattctgaaagaggccggtttacctttctctacagataatttccctgaagaacctgattatgtaatttcatttatttatgacttacatgatggctcagaaccaagtgaattggctatgagtcaatggaaatccagaagacctgtatatgcatttcaggtagttaaatcaaggagttaactatgttaggtgataacactaatgctctgtttggggtgtcagccagacctattatcattgttaataaacatcatggtaagaaaggtgaatatattgggcgtggttctcctctgggtaatccattcgttattggtaaagatggaaccagagaagaagtaattgccaaatataaagtatggctacaagaacagattgataaaggtaatccagttgtactgaatgaattaaatcgtcttggtaataaagccattgatgaaaaaggattagctttacagtgtttctgttatccaaaaccttgtcatggcgaggttattaaagaggagttagtaaaagctatgtataactactttgtggaaaatcctaatggataaacaatgcaaatgtggtaaaggctatatatcccaatgggatgataagtgtggtcattgtagaaccaagaaagaacaacgtgaccacgaatatgcacttcaagaaatgattgtacctgttgagaatttaggtatggctccacttgaggcttacaaatatataaggagattatgcaaatgaaagaagtattcgtatttggttctaaccttgctggtgtacatggtgctggtgctgcaaagacagcatataagaaatatggagccagatggggtaaagggcatggtcattatggtgacagctatgccattcccactaaagataccaatatcaaaacaatggctattgaagacattcgtacatttgtaaacgccttcattgtctatgctgctaatcatccagaacttaactttaaagttactcgtgtaggttgtggattagctggtattgatgattctgttatggcctctatgtttgaaaatgccactggtaactgttcctttgacttagcatggaaaagttacttaggggacgatttcaactactggggaacgttctaactcatatgttaggcaataagctgctccgcagcttttggtaattaatatgtttaaccaattttggagaatatgcgatgtctactatcgaacatcagatgcacctcgaaaagctgtacaacaagaaccaactgttaccaagaatgcgtcaggagtttgaagaaaactctggtattgatttcaaagccttctttgcacatataggcattgattacaaatttggcattgatgcaatggttcaaatggctctgcataagcgagctgacctaccaacattagttggtacattgcgtcatcactgcaaatctgcacaggaagtagcagacaacctttttaagatggcaagtgaggattgctttaactttgacccgaccatcgacaagttcattgtcatttatacaatcagcgatgacgtacagcatgaattggattcatttcagtatccattacctacggtagtgcgtcctaagctgttaactaagaattacggtactgggtacttcacatgtaataagagtgtgattcttaagaagaaccatactgacgatgacatttgcttagaccatctgaaccgtatgaacaagattccattgtctatcaattgggatgtagctcatatggttaaaaatgaatgggctaatctggataaaccgaaagaaggcgaaactcgtcaggagtttgaaaaacgtgtacgtgcattccagaaatatgaccgtactgcacatgaagtaatgggtttattgacccaggaaggcaataagttctatctgactcatcgtccggataaacgtggtcgtacctattctcagggataccatgtgaactaccagggaaccagttggaacaaggctgtccttgaatttgctgaaaaagaagtaattgattaagtaatccattaatgcaagccaataggctaagacgcgaggaatatacaatgcaaacttttactgcccgtgaatatctgaaaattgacattgctaataactatggtctggataaagaagactgggatgaccgtattgcatggttcgataagaatgagaacaacctactgaaccttgtaagagaagctgaagaaccagccctgttctatgctggtgttaaagcatggatggatgttaaggaaggtaagccaattggttatcctgttgcactggatgctacatcatctggtctacagattttggcttgcctgactggtgaccgtagagctgctgaactatgtaacgttgttaactatcgtgatgaaagcggcaaagttaaacgtcgtgatgcttatacagttatctacaacaagatgctgaacactcttggtaaaggtgctcgtatcaaacgtaatgactgtaaacaagcaatcatgactgctctgtatggttcagaagctaaaccaaaggaagtatttggtgaaggcattatgctcaacgtatttgaaagcacaatgaatgtggaagcacctgccgtatgggaactgaataaattctggttacagtgtggtaatccggaggcttttgtatatcactgggtaatgccagatggctttaacgtatatatcaaagtaatggtaaatgaagtggagactgtccacttcttagataagccatatgactgtattcgtaaagtacaaggtactgaagagaagactcgtatgctatctgccaataccacccactctattgatggcctggtagtacgtgagctggttcgtcgttgtgactatgacaagaaccagattgaatacatcaaggctctttgcaatggtgaagctgaatataaggcttctgaaaagaactatggcaaagcaatggaactgtggggttactatgagaagacaggattcctgactgctcgtatctttgattatctggattctgaaactattaaattagtaaatactcaggacattctagacctgattgaatccatgcctaagaagccattccacgtacttactgtacatgactgcttccgttgcctgcctaactatggcaatgacattcgtcgtcaatataacaacctgttagctactattgctaagggtgacttactatctttcattatgagccaggttctaggccaagaagttactattggcaaactagacccgactctatgggaagatgtattagaaaccgaatacgctctatcttaataactaaggctatccctacgggggtagcctttatttttttagtaaatcataatggataggcatttaacctatgaggaaattaaaatgcctgttcttaaagtgatgtttcataaagacaccaacgtagctactgtactggatgccagtggtagccttagtgatggttccgttgaggtgggtactttccatcaccctgatgaaacctatcctgatagtgtaactatctatcatggtgtacgtgacctgctgtataaacgcagtgctaaagacccatctcaaactgcttcttacccaaataacattatcaatatgcaagttatcagtattgatatgaaggcaactcctcgcctaattctgggtactgcattgcctcgtgtaatctctactattgaaggtaaagatgtaacctggcatgtagatgttgctggtggtaaagcaccattgacttacaagtggcagtttaaagctaatactgtaggtgctgctttcactgatattgattccggagagaatcctacagctaaaactgcaactcttattaaccatgcagtaactgctgaatctgctggtacttataaagtcatcgttactgatgctaacggtactactatcgagagttcttctctgctggttgtaggagttcaggaaccacctgaagtagcttctattgttgcttacccaagtccactggctctatcagtagctgatgatattaccgaaggtaaaacagttaagttctcttccctgcctgctggttctttgattggtactatgtccattaagacccagcctgacagtggtaaagctactgctgagattagtggtaatgtactgacagttaaacctgtagctgtaggtgacactactgtagtagtcaccaacggaaccaaggaagtaactgttacggttaatgtcacagagtaatgtgattgtttttatgaatgtagccctccttgtgagggctttttagtatctataggagagtaaataattatggccaataagaaccgtcttcgtgtatggcatattcctcaagtacccggtaaagctttctatgttgaagtagattcagtagaagaaggtgtacgtatcattgatatactagccaactatgacctattccagtatgagaacaatatcaaaggtgattactgcaacgtttctggtttacagatgtatgatgaacatatcactgatgatgaaatggaagagatgggtctgactgaccgttgggtagactggtactatgaagatgaccagagcttttttgataacccgaaagagtatttgaataatctcaagaagtagtttcttggggttaatgacctctattaattccttatcctttgccctcctatggaaggtttttttatggagtacaaatgtttaagttcttagaccttatctgggtagtcattttgttggttgctacaggctttgtatatggcttcttgctcccatcaatgatgtctgctttagacagcatcattgttgttatgggcttgatagtctgtattgcgtggcctcttatcgtaggccgtatcgtttatcttacagttaagaaaaggatgagaagaaagcatgtataagtatattgcagtagtaattgcaggattaatcattgctctgagtttaacgagctgctatgaccgagttgaaccaggtaatgtgggcattatcgttaaccgtcttggtgaagacaaaggtgtggaaaatgaggttaaaggtgtaggccgttactggctcacttggaatgaagaactttatacattcccgacctttaaacagatgaagacctatgatggtctgttctacttccaactgtctgatggtactcagataggccaccagatggctatcagctataaagtaaatcccactaaggtaactaatatcttccagacatatcgtaagggcgttaatgaaattaccgagcaggatttacgacaacgtattgctgatgtacttaacaggtcgggtaacctgattaacactgatacatttattgatggtggcaaatctaagttactggatagtgtcactgatacaatccgtaaagagatggaaccagtggggattgatattattgctatctcctggattggtgctcctgaataccctgataacgttaaacgtgctattaatgccaaagtagaggctactcagaaaactctgcaacgtgagcaagagattcagcaacgtgtagctgaagctaatatggaacgtgaacaagctaagggtgtagcagatgctattctgattaaggctaaagcagaggctgatgctattcgtttacgtggtgaagcactcaccgagaacccaaatgtaatgcaactggaagccattaataagtggaatggtacattacctaccacaatgattcctggggctactacacctttcgttaatgtgaaataactaagcaaacccaccattacggtgggtttattttttgaagttatctaacaccgggtattcctatgaaagtaaatgttttacgtcgtaagaaagttcctttctttcaaatcaattgtggttcatgttttcaacatgatgatgagtactacatgaaatgtagttatcaatctaaagaacacttctatggtgtgaatttacaaacaggtcatctgttcacatttgataataatgactttgtttatcctgtgactttagaagcatgtattcctgacccacttaataaatagtatggctcaagaaaagaatcgtcgtcagacacttatcgaacgtattcaggccagaatcaaattacaggacttaggctataccgttaatggtcagcctagtctctgtcacatctggactggttcacattcaggtaatgggcgtggtgggcaatatggcaggatttccgtgaatggagttacctctgcaactcacattattgcctatacccattatcatggttatatccccaataagatgcaagtagaccatctctgtaataatcgtctgtgctgtaaccctgaacatcttgaattggttactcaccaagagaaccagagaagaagggctaagcgttctaaatctaaaggaaataaataaatgattaaaaaacttatttgtaaacttattgcagcaatcttaattagtattattggtttcgcatgggtaatttctactccagataatgctatgcaacaaatttattatgctgtgtatacatcaacctcttttgtttgggtttatgtaatgtaccgtatttgcagcgactaatacttaatatagcttaaccggagagtaaaatggctagtattgattctattgccgtatgtaacccacggcaggtacgtaaatttgttgaacactgtatccgttcaggattggttccatttatcacttcatcccctggtatgggtaaatctgcaattgttcatcagattgcagaagactttggtctgaaactgattgaccatcgtctgtctacttcagcaccagaagacctgtcaggtctgcctcgttttaaagaaaatggtcgtgctgaatttgccccatttgatgaactattcccactggaagaagatgctgtacctgaaggatttaatggctggctcctttttctcgatgagtttaactctgctcgtaaagagattcaggctgctgcttataaactagtacttgaccgtatgactggtcagaaaaagctgcatccttatatagctatcgtgtgtgctggtaacaaagcaactgaccgtgccattactaataacctgtctacagctatgcaatcacgtcttattcatctggaaatggagactgattttgatgtcttcatggaagatgtagccatccctaataagtgggatgagcgtgtaattgcattcctgaatgctaacccaaataaactgaatgattttgaaccagaccatcaagagaagactttctgttgttctcgtacatgggagttcgttaacaagattgtttccattctcccaccgggaccaattgatagtgagatgactctgctgttagcaggtactatcacttctggtgtagcaacatcatttgttcagtttacccaggtctatagcaacatggtgtctttgaatgagattttggataatcctaagaaagctcgtatgcccgaagacaataacctgttgtgggctgtagtcacttcactgattaacaatactgacgaagataatcattcaaaaatctttgattatgttgaacgtatgccgtttacgttcaaggttttgtactaccgttccgtaggtagtctggttccagctttggttaaattaccgaactggcgtgttgctgcaatcacattatctaaatacgttcatggttccaattaacaagaagggagttacagacctcctgtatgttgctggctttaacggtgaagaaattaccgtatatgccccaagtctggctgctgctaaacaaaaggcagttgaatactttcgtccaaagaaacgtgtagcccatactatttgggttcatctcgcagaggaaaactgatatgtccatgacagatgctcaattaacccgtgaatatgacagatgtcaggctaaagcctttatgggcaaaactgctgcattctttggttcactgttatgttctctgaagttccgttgggtaaaagatggctgtgatacagcacaaaccgatggtgagcatctcgaatggaatcctgattggtttgaaagtctattacctgaatctcgtgtaacagtactcatgcatgaactgtggcatgttggcttactgcattctgttcgtatgggttctcgtgacccagagatgtggaattatgcctgtgatatttatatcaacaatcagcttattcaggatggctacagctttataggaatcgaaaattgctggaaagaccctaagtatgctggttgggctgaagaacaaatctatgatgacctcatgagcaaacagatacgtcctcctaaagcatcaggtgcttttgggactggctcaggtggtgacatgaaaccttccacttcgaaggctagtcaggtgaatattgtcaataatgtagtaagagccatgcaccaacagaaactatctggtggttctttgcttggggtattacctggaaaaatggaagaagttattactcaattcctgaaaccagtagtaccgtggcaggttttacttgaacgcttcttcaatgacctgcaagaaacttactattcatggcaacggcctaatcgtagataccctgatatgtacctaccatctcctatggatgatgacggtagactggaacatctggcttatttcctcgatacatctggctccattaaacctaaagatgctttacgctttagctctgaagtggcctatgtaaaagagaaatatcagcctcagaagatgactctagttcagttcactacagagattgtagatgaacaagtcattgaagatggtgataagtttactgatgtcactatcaaaggacgtggaggtactagtctggttcctgtacgtgaatggattattaagcataagcctactgctgccattatctttactgacttagaagtcagaccgatggagccattgccatttgacattcctgtcatatgggtagttattcgtaaccctggcgcacaagttccatttgggaaagttattaacattacatgaggttttatggttgttaatggaaaactattgttaggtgctatgcctattaagggcatggttaacagtaaactcagttcaggtgagactacatttggactgggagaagctggttatgacatccgtattaaacaggatgttaccttctaccgatttcttggtttgatcccctgcatcaagattaaagatgaaggaaaaaccaagtggaagtttggcactttcacattagcttctgcaatggaacgtttcaatgtacctgctggcctagtgggtattgtccatgacaaatctacatgggcaaggcgtacattatctgtattcaataccgttattgaaccaggatggtcaggctatctgactttagaactggtttatcacggtcgtaaaaaacttcatatccctgctggttcaggtattgctcaggtcatcttccatgagacagtagagaatactgcctacaatggacgataccagaaccagcctaatcaacctgtagctgctaagtcagctcgttaattaaggaaatatcatgtctatctttactactaaggttaatggtcaaaaagttactgttgttgctcgtaacgtagcttacgttactgaaaacagtgaaggccgtggtgtaattacttttactaacggtgattccattgatacccaggtaggttatgactctatccgtcgtaacgtagctaaagcacttgatggtgctaaagacatcgcagagtaaggtgtttacagtaatggggctatataatagccccatttatggaaacaccttactccattgcttagtcccaactatgcccactttatgtgggcttttttaattagagactatgtatgagcaaactaggtatacacgtttacatagatgaagccgagaagatatacccctatacattatttagttccagtgatttacttcagatgaaggtaaactccatcatcgtaaactactggtataacgataagaattgggattactgggctgcacgacagaagagtaagaacaagaaagatatattcaaaagcaaatcaactccacatatgtttccttggtatcacagaaaccggagatattgatgacaagaataccatttttaaaacctagaaaacgaacaccaaagctgtatcaaaagacttcagaagacggtttagccttgaaccagaaagctattaaggctgttagtgcactggttcaaggtaaacaggatgctgttgctttacgtcttgttgttgagcaaatcttagttgctctggcactggctcaagtagctaaacaagaaggtaaacaagaaacctgtaaaatagcattaggtgctttgtactggttgtataaagaccttgctgacaactttgaaatgtctatggataagtggcagggcatttcttgtgtacttgctcttagagaagggcaggaattactgtctactctaccaaaagcagaatttaaactagcctacactggagcacataagattgttcttggttccagtaaggacatctttaaccacctcaagctattcaaggctttctatgattaatgcaaaaatcctcgctgatagtattactctttctggtgaccgcctggtaacaatggaactggtttatccacgtttcattcattcagaatttatgactcaccgagcacttaatcgtaatgcttccagtagtcgtgctattcctacccaacgccttattgagcaagttcgtaatgaaccagtaatgccagtacattggggtaagaaccagaaaggaatgcaggcaagtgaagaactcactcctatggaaattaaggatgctgagttcatttgggaaaatgctgcctctgctgctgctgtgtatgctgaacaacttcgtcgcggacaagtacataagcagattgttaatcgtattctggaaccattcacgcatatccgtgtagtagtgacagctactcaatggaataacttctttggtttacgtatccatcccgatgctcaaccagagatttgtgaattggctactaagatgaaggaacagtatgaccaatcaaaaccccgtaccctgttggctggggaatggcatttgccatacattactaatagtgattacctcgatgcttacgattattgcaaacatcaacgaattactcgtgatgaaccaagtagtgatgagattaattgcctgttagtaaaaatctctgctgctcgttgtgcccgtgcttcctataacaacttcaaaggtactccctctactatcgaagaagccctgcgtttgttctctaaattggttgaaagtaagcctgttcacgcaagccctactgaacatcaagcaactcctcagcatgtaatgagtaaaggcttaaatgagcctactgacccatctacatgggaaaatggcattagccacatggacagaaatttacgtttatactcaggtaatctgtgtggctggattcaattccgtaagctgcttgcagatgaatgcatccactaagtaggtcttttgtgggtgtagaccactcataataaactccgctatttgccccctacatgggggcaatttttttgattccatgtacataggaggctatatggctaaaccacgtaaattccgtattaaggataagcctgtaatgggtagtgctgctggtcagtcacatgagaaaggagacattgtttatgaatgccttcagtatgattacggcgttgctcatgatgacactcgtgctactggtgtcccacatacctcagtaactcttgaggaagatggtagctacccattcttcactgttcctactcataacctggaagaaattcatgattgacccaaatatcatccatgccaaaacaggcgaatcccataagctgtctgaatattccaaagtagaagatattgcagtttgtcctgcaaatattgcttctctttgcatctgtattgcagagctatctaaagaacgccaactatggctatctcctaataaaacaatggtccaggcaggtctggcagaagtacaacgtatgctggatgaatggtctgaagaccagatgttcattgatggcaatgcagaagcaataaccgatgacatggcctctgatatggctgtgtttgtattacaagcaatggctgaaaaacgtagtagttaattaataatttactggagaaaattcgatgcaagtagctgactctactgaactgaccacatcagcaacgttgggtgctcaagatgctatggccttcggtatttctgaagacccagcattcttccaaatactcagtgctaacctctattctaatcagaaactggcaatggtacgtgagacattgtgcaatagctgggatgctcatattgaggggaataaaacagatattcctatccatgtaaccattaataaggatggtttccttatcttccgtgattatggttctggtattcctaaagataagattcaagaagtctatggggtatacggtgcatctaccaagaaagctaatactgcttctactggtggctttggcttaggatgtaaatcccctatggcctatacagacagttttactgtcacatctatgtgtgacggaaccaagactgtctatcacattgctaaatcttctgttgagactaacggtaaaccagggattattcctatcgttagcgtacctactgaagaatcagggcttgaagttaaaattcagcttcagtcagaagatattttagaaattgattcatatattcgagccattgtattacatggtgagattaaatgtatttactgcaatcaatatacaggaccgagtacagtggaattactacctgtactgggcatgtcttttgaaccaggcagctataacctagaccataacacatggcataaatattacatgggaggtcattcaatatttatccgttatggaaatgttatgtatcctgctttggatacccctgctacacatgacgcattaaaactggttaaacagtttatgcaggttattaactgtagccgtatcgttgttcaagctgctccatcatcactagctgtagcacctagccgtgaaacactgtcatctcaaaaaatgactgaagacggtatcgtaaatttggctgtagctttagtagataaaatggaagcagatattaaagctcgtcttccaaatgctattgaatatattgggaaggctattaaagaatatagtcctcaccgttttgaagtaaatagttatttgccttacaccaatttagtgcctgatgttattgtcagtcgttatatgtcctctactttattcagtaagcaatatgctcatctgtgtaagaaatggggaaatatggaaattgaccgtcaacttgaacatcctgcactggctcatttctctggttctcaaaaagcccatctccgtaagcatttaaagagggctaaggatttacgtaattacagggaattaactaaagtatttactgatatggctattaagccaatgttcaaaacctttgctaaattggggattactaaaggtatttccctatttcattatcaatacggtgttgaactgtggcgtaataatattgttaatagtgtccgtagaatacactcattaaacttcatgacttatagttctaggaagtgccgtgtatttgttaccccacgtattaccaatattgaagatagtctggctgggtatccagagtttgataatctttctactgagacactggtgaaatataactcaatcattgtcaaagttggaaccaagaaaggtgaagcagaagctatgactaatctgctcactaaagcaggatacgaagtcattaatatggctgaatatcatgagtgggattgtatagctcgtagacgtaaagaggaacaagaggctaaattagccatttccaaattacaagctaagaaagctactaataagaaaaaggttagtcctaatcgtcttattagtatgaatatccttgaaataccaaaagagcatcgtagttattcgagtgaggtatgtggttctcactacgcttctcgttctcatgaccgaatggttgatgtggatacccctcagtattacatcatgcaggaagatattaataactacacaggaagacttggtgttctttctatgtggcaattaacccctgctgccattaaagatgtgactgttgtttgtcgtaataaaattgaacgtaataaagctattaagcgaggtgctgttcatttggatgaatggactgctccgtatattgcttcagttcttacgtctaaacaattcactaagtatgtcactaaagaacgtcagaaaacattaagtgatattggtatttactccaaacacctcagattactgagagaactggatattacatatgccccattgaaaggtctgcgttatgacccagaactggagaatgcctatctctttttacaaaatagtagctaccctaagctgcgagcactgttagggaaggggctgattactgaagaacagtatcacttcttcagtgatgttgatgtgcattgcaagacttttagtaagtactcagaacttcgtaggataccgaagatgttcctcgatattgatgttgggggttatatgttggctgcatgtactgtagacacactgcttcgtgaaatcgaacaattccctgaatcaatccctgcaatcaaactgcttgtaaaagctgcacttaaacggaatacagactgatgaaacgaaattatctcgccattattgccctgtcagtagacagccgtaatctcactttatggcaacctgatggttctactatggtcatcccccaaggggatgcccgtgtaccacgtattgttgctgaagcaaaagaaaaaaatcttaccccaggtaagattattgaagtggatgtcactatcgaagctcagattcgtcaggagtttctggacgctgaacgtgatacaggtggctttgttaaattcttccgtattaccaagaagaagctacaagagttcttcttaggggaagaggaagaacaagtcccttatgtatcacctgtagagttaggcgctaaacccactgctttcaatgcttttattgctaatgctgtaggcaaaactcttgctgtacaacatgcatcattaaaagcacctgaaccagaaatgacagttactcatgagcgtttttacggtagctatgctgtatggattacagatgtagacccacggaatcatcgtattgaggttattcatgttatccgtgaaatctcaggaagaaccagtgaatatgtcaataacctgctggctcaaccaaccccattcaaagtatttgattggctcacagagactcaggctaaagagtttgtaagacgtcttaataacactcatggtgttatctctgtctataacaaactggaagacggtattcctgctaaggttgctgtaaaggcctcagagccaaccaataaggaaaagctggaagctgcatcaactaagctgaaagctatgggtgctgtcgctacagatgcttatgaatttcatactgacttgaatgagaatgaagagactattgtagctgtagtgaatgataaggtggttcctgatgttcagaacctacaccgtcatatccgtcaatctgcaaatctgaaagactataaaggctttactaagttccttgaacgtctgtctactgtaattgataaacgtcgtcactctgttgaagacctgatgaagtttatggaaaaaggtgacctgccaattgcagatgatggctccattgttatcttcaaacgtctggaaagcaaagacaatcctgaacatcttaaagatgtaatggatgatgtatttgttgattgccattctaagaagattgagcaatgcgttggtatgcgtgtaatggttaaagaaagccttgtagaccagaaccgtcgtaaagactgttctcatggtttgcacgtagcttctctgcaatacattcgtaatttctcaggcaacgtaaccattattggtaaagttgctccagaggatgtatttgcagtaccagaatacgatgttactaaaatgcgtgtatctgcttatcacatcattaccaagctacctgatgctattcgtgaccatgttaataatggcaatccaatctccaccattgagggcggtacggaaatcctgaacatggttctcagtggtaatcaccctgaaccttctcgtcaggtactggttggtggtcattatggaaccaatctgacttattcagaactcacccgtaattatctggatgatgaggaagacatcgttattccagatgaaccagtaattaagaaaactgccttgaatatggaagagagctttacggcaactaatcctaaagccgaaccagtgaaggcaactgatgttaaacctattaagaagactaagatggaaattcttaaagacctttggaaccagttcctgaaagcagagacttctaatgaagctattacgctggctgatgaaatcattgctgctaagggcaaatgtaagaagtcatgggcttctttaggcttcagtggtgacatggttcagaagctgattgatgctcgtgctaataagcctaagccagaaaaagcagtcaaacaggataaaactgttgcacctaagaaaactacagtcacccgtagccggaatgctgatgttattcgtagttatctgaatgacaaaggtatgtctgattactgtaaagctcatgccattcacgatgtgaaacgtgctgctaagaaatcttatgctgcactgggtctgactcctgaagaatgcagccaaattgataaactgaagcatcatctgaagtaagtaggttaactattcaagtagctccggttgaaatatactggagctatctttgaagaggatacatactatggccaaagtttatcgtgctaaccgtaaagcccatgatgacgatattatccgtatgaatgcagtcggtttatcattgggaaccattgctaaaacattaggtgttcaccccactacagttaccttacgattacgctctcttggtattgaaccagccgacacacgtcgaacatttatggagaacgtactagcaccattacctactcacgtagctgattggttatcagaacaagtaggaccaaagtatgagattcgacaatacgttcgagacttattactggaagcctacaataatcgtcataatcataaggaaactgctcatgaacgattcctcaaaagatacgttggtacaaactcagaactggtttctgaaggcagtacccaacccaacgagtaaaaacattagtacacaaattggttgccatctggaagaagtagcagaaatgctagaagcaatatgcagcgtctacaaggaagacgataagaaaatagcttatctgagagaagccattgttcatgtagcagacctcattaaacaaaatgggggtattgctgtgaaagacccaaatgatcttttagatagtattgctgaccagattgttacagcaactggcgtcggtactttcttgggtatgaacgtacctggagcactcactgaagtgaaccgttctaattattcaaaatttgaagacggcgagcctgttttcaatgagaataagaaagtaatgaaaggcaagaattacactccgcctgatttaaccccattcatttaaaagagctgcccatatagggcggtttttgtatctggagaactcatgtataaaagtactactaagctgccactaaatcctggtcaagaggcagcggcagaaggtttcttcgactttctgctcgaccccaatgcttctgaacttcgtattagtggacctggtggtacaggcaagacatttacaatggctcatatgattgacgagattatgcctcgttaccatgagacatgcagtctgatgggaatccctgctctctataacgaagttattatgactgctactactaataaggcagcagaagtattagcccgtgcaacaggacgtcctacgtctacctatcattcctttcaaggtctgacagtacggaataacctgaaaactggagaagcagacctgattccgtctaagtccttcagtattaaaaagaataaggtcatctttattgatgaagcatcaatgattgaccgtaaactgaagaagtttattaacgaaggtactcaccaaagtaagattgtttacttaggtgataaatgccaattgttacctgtaaaggaaacttcttcccctgtctacaatgacagtagcattaaagagtttatgctgacccagcagatgcgtactgatgtccctgaactccatgcactgcatgaacagcttcgtggaaccattgaaggtaagcatggattcctgcctattaaagcagttccaggtgttatcgactggattgaggatggggatgaaatgaggaaagaagtcgaaggtcatttcatgactaagacggacactcgtattgttgcctataccaaccaacaggttgttaactataacaccttcattcgagccatgaatggattccacggagagttctgtattggtgaagagttagtaagtaactctgctattcagattggtgctggtgaccgcctcagtattgaacaggaatgccagattgttgaccaggactctgctactcgtaagattctgattgactcctctggtatcgaattagaagtacgtgattgcactctggatactggttatggtggtgtctttgaaggtatccctattccggtagatatggattatttcattcgtttgcaaaagtactatgcacatcaaaagaactgggaacgtcatttctatttgaaagaaacattccctgaacttcgagcattacacgcttctactgtgcataagtctcaaggttctacctacgacactatctttattgatgctactgatttatctacgtgccgtcagcctgatgtagtagcacgtctgctttatgtagcagtatctcgtgctcgtcatcgtgttgtgttctatggctctttggcagagaaatttggtggtctggttcgctaaggagaacttatgcaactgggtgaaaaacaaatccgtgaaatgactaatagtagtgaactggttcaggaattattcttagccgagttacgtcggctagataaagtgctggatagtatcattacacgtaatggggaaacattcgctgtatacaactcaacagggttcctgtatttaggggagttctattcgagttcccgttcatcacaacaacctccttctggtcatcgtctggctctagctaatcacctactggatgatatgcgggagtatctagaacaagcaggtaaacttctgctagaagtccatatggtaaatcagatggtctttcgtctggttcagggctgtaagacttatcaagacgttcgtgatgcattgccagaatgcctcattgctatggataaacagggtcatctgaaatccttacagagaaccggaaaggcagcatttactctggataatgatgctatggctctccgtcagtatgagaaaatcttgccgattatcgaatactatgcgggaacccatcttatcttttgaggtctgtatgcgtcacattacattcaacaatgagggtatctaccctattgctatccttgctacaacgttacgtaaggatgatattgtcaaagcatacatggaaccctgggatgtagataaagattcagtaatgattcttgaacttcatacagccccagggaaaaagaaaactcctgctaaagagatgcaggagtttattacccaagaattagtgccagcattcgaagcagcacaaactcagtatatcatctgtggtgattctgaatattacaaacagctaaccaaacaaggtaaagctgatgccaatattggctatgtaatggattgtgcttatgggaaccagaaagttatttacgttcccaattacagacaaatcttttatgacccggataaggtaaagactaagattgctttatccatgcaggctttgattgattatgtctccggttcttatgttgaaccaggaactaagattatccactatgctgattatccattaactccagaagctatatctaagtggttagataagttactggagatgaatgttccattagcagtagatatagaaaccttcagtctgaagcattatgactgtggtataggcactattacattctgctggaacaagcatgaagggattgcattccctgtggattatgaaccaattgagggggctactgaagctccttatggtagacaagttcacaacatgcttgttcgttctatgctcagggacttttttattaagtatctgaacaggcagatgtatcacaatattgcctttgacgtatatgcactcatttaccagttatttatgacagaccttctggatacggaagggttgttgcatggcatgagtatcatgctaagaaactgggattgcactaagttaattacctatctggctactaactcttgtgccggtaataagctaagtcttaaagaccaggctcaggaatatgctggtaactatgctcaagaagaaatcaatgacattaccagaatcccattagcagagttgttggaatacaacttagtggatggattatgtacctggtatgtctatgaaaagcattgggatactctggttaatgaccaacagttagatgtttatacaaacatctttaaacctgcatgtgaagatattattcaaatgcagttaactggtatgcctatcaatatgaagacagtattggaggtagaagaggcattaacccaagactataacaatgcgttaaaaacgattgctgacagtaaagtaatcaaagattttacccgtcttcttaatgaagaatgggtagaaaagcagaaccagattctgaagaagaaacgagtgactttagctgatgctaaagaacagtttaacccaaactcaggtgttcaattacagaagctactttttgagtttctggagttacctgtactgggtctgactgcaagtaaactacccgctactggtagtggcatactcaagtctttgaagaaccatactcaagataccagtattctggaaattcttgacgctctgattgattacaaagctgtagataaaattctgacagcattcatcccagcattaaaaaatgccagacaaggaccagatggttggcattatctttttggtaacctgaacttaggtggaactgtatcaggtcgtctatccagtagcgaaccaaacctacagaacctaccttctggttccagatatgccaagatgattaagaaatgctttgaagcccctcctggatggatattctgtgggctagactttgcttctctcgaagaccgtatatctgctttaacaaccaaagaccctaataaactgaaggtgtataccgatggttatgatgggcatagtcttcgtgcgtatgcttacttcggtgagatgatgcctgacattgaagatacggtagagtctgttaattctattcaggagaagtacaaagcatatcgtcaggattctaaagcacctacctttgctcttacctatcagggtacatacatcactttgatgaagaactgtggtttccctgaacagaaagctcgaatggttgaggaacgttatcacacactttataaggtaagtgatgactgggttcaggctaagctagaccaagctgcaaaagatggttatgtaaccgtagcatttggtctacgagtcagaacccccttacttcaacaagttatccgtggaaccagtaaaactccttatgaagctgaagctgaaggacgtactgctggtaatgcattaggccaaagttggtgtcttctgaataaccgtgctggttcagagttcatgcgtaaggtacggaatagtaagcatcgtcttgatattcgtccaagtacccatatccatgatgctcagtatttccttatccgtgatgatatggatgttgtgatatataccaatactcatttggtgaaagcagtacaatggcaagaccatcctgatattgctcatccagatgttcatttgggtggggaactctccttattttacccaacgtgggctaacgagattgaaattccaaactacgctacgcccgaacaagtccatgaagcaatccaaaaggcatttaaatgaccaaacaaattgaagagaaaaagcatcactggttagtagcagctcaactgacttttgttattcctgataacaaagatggacaggaaggtgctgttattgttcagaacactatgctgcttactgaagagaaacaggtaactttccgtgacctggggcgtgctcagtctgctctgtttcagaatctgaatgaccgttttggtcaagtggtagatgtacgggatattgtattcctgaacgttagctacctgggtcatatgagccagcctgacttccagcaaaatctggtaactaaagatactgctgcgaagaaagctaaactgaaagctgtggagtaatcatgtctgaaaaactgtcaggtggttttaataactactatctggttcaggtaaccaaccctcaacgtatggaacagcccccatatcaggccgaatgtgaggatattatccaagcactgaatatgacctttgatgaagggtgtctgttcaaggcattgtggcgtaatgctgctgctcgtttaggtaacggtaaaccaggtaacactgccatttatgatgcagagaagatggttcattatgctaaccgtatttttactaaagaatccgatgggcagaaaaaagaagcagaagaaccagtttctgaggctctgaagaagggtgaagagattcatatgtctctgtctgaattattcaccctgttaactggtgaagcagcagaaggtgaagtaatgagccttgctggttggcatactcatgtacccaaccgtttgggtgttatgcctattgctgttgcaatgagcaaagcagaacaagttgatgtagtacgtgccgatggaacgactattactcatgtgtttcctcatgagattgactggtctgataagattgctccctttgctcgaatcactgcatggcgtttcagtaacccatctaaggtcgcttctaaatgaaaatcacgaacaatcatgacgtgtctttgccattagctgtttggcttttgcatgacgagtatgattacgtgaaggataaaaagtatctttctgtgactaccctgcttaagccaattaagcatattgtcatgaagcatcgtgtagacctttctgtagaaagtatggacatcatggatttggtgtccacttctatgggtacaggcttacatgattctattgagaaggcatggcataacggacaccacaatgcattacgcaaattagggtatcctgagcgtgttgttcagaatgttgtcatcaaccctacccctgaacagattgcatcaaatccaaacttaattcctgtatggatagaacaacgagcaactaaaaagattgctggttggactattggaggcaagtttgacatcgttactgaaggtcttcttcaggatgtaaaatccacctccacttacacatgggtaaagggtggacgtgatgaagaacataaacttcaggggtcaatgtatcgttggttgcatgacgacaagattaccgaagatgtgattcgtattaactacatcttcactgactggatgaaagcattagctacatctcaagaaaactatccaaagcatcgtgtgctgcataaagacattccattgatgtcttatgaagcgactgaagaatggattaaagccaagctggctctcattgataagtactgggatgctcctgaaagcgagattccagaatgtactgatgaagagttatggcgttctgacccagtgtttaaatactttgctgatccagagaaggcaaagcaacctggtgctcgttctaccaaaaacttccctactctctttgaggctcggaagttcatggcagagaagggcaaaggcactattcttcatgttcctggtgaacctaaacgatgcaactattgctcaatttttaacatctgcgaacaaagaaagagatatttcccatgattgacctgaccggagtctcacatcatccggcgattgaagaaatcgttgatgtgttatgtaacaagacgcaaaacactgaccgtggttttttccgtgtagaagtggcctatttccttgcgaaaatggcttcatgtatgggtgcaactatcatcactaaagaccgtggtgaaattccagtaaacatctatgcagtggctcttgctacttcaggcttcggtaaaggccattcggtcaacattgttgaagacggttttatggctggctttaagaagcggtttatggaagacaccatgcctgctttagcagaagaccgtctgtggaaaattgctaacgaacgttctgctcgtaatgctactgaccagaaggaagagtttgacaaggtggaagcggaatacagacgtacaggtgcttatccatttacgtttgactcaggtacacctcctgctgtgaaacagttacgtcataaactcttattagctggatgtggtgctattaacttacagattgatgagattggttcaaaccttctcgctaatgctgatgtattaactgtgttccttgaattgtatgaccaaggcaagattaaacagaaacttactaagaatactgctgaaagtattcgtagtgaggaagttgatggtaaaactccggctaaccttcttctgtttggtacaccgagcaaacttttcaatgggagccagactgaggaactcttctatgacttccttgatactggttattcccgtcgttgtctgtttgctgtaggtcaggcagataaacgtgcatatctgagccagagtgctgaagaaatctatcgtaatctgattaagcaggataacaatgctgttgtgaataagtgggctaaccactttcatagccttgcagatgcatccaagtttggttggaaaatggcagttgaagatgatgttggtattgcactaatcgactacaagattcagtgtgaaaaacaagcagcagctttagctgaccatgaagagattcgtaaagcagaactggaacatcgctattttaaagcactgaaattggcaggtgcatttgcatttgttgataacagtatcatggtagagatggaacatctgaagcaagcaattcttctggtagaagagtctggtgttgcattccagactatcctcaatcgtgaaaaagcctacgttaaattagccaagtatattgcatctgttggtactgaagttactcatgcagatttgcttgaggctttaccattctataagagtgggaatgctgcacgtaatgagatgatgactttagctactgcatggggctataagcagcacatcgtcattaagaagacatacaacgaaggtattgagttcttccgtggtgagacactgaaagaaactgatactaacgaaatgattgtttcttatggtgagaactttgcttatgactatattgcagagaaagttccatttgaccagttacatgtactgacccagcaagcaggttatcactgggctaaccaccatttccgtcgagggcatcgtgctgaagagaatgctattgctggcttcaatatgattgtcattgatgtggatggtacgtgtagtttggacgtgtgccatgaattgatgaaagaataccgattcatgacatatacaaccaaacgccatactgatgaagaaaaccgtttccggttaattattccaatgaactatcagcttgaacttgatggtgctgaatataaagagttcatggataacgttatggcatggctcccatttaaaacggacgagtctgctaatcaacgagccaagaaatgggaatcatgtgctaagggtacgtattactacaatatggatgctcccctgctagacgtaagagatttcattcctagaaccagtaagaatgaggcattccagcaagggatgcagaaggttcagaatctggataatcttgaacgttggtttgcccaacgaattgctacaggcaatcgtaataaccacatgattaagtatgctctggctctagtagatagtggtataggcttcaatgaagttaaacaacgtgtgcatgagttcaataagaaactcagcaatcccctgtctgctgatgaactggattccactgtaatgattactgtggctaaacgttacacatcttaataaaaactattcagtccttttcttggttgaagaggactgtcagttaaaagaggaaactatgtcagaagaatttgaacatggcgaaatgaatgaccagctaatcctgattgtaggattttctgctgctggtaaatcggcctcacttcgtaacatccgtaaccaggaacgttgggtatatctgaatacagaagctggtaaacgtctaccatttaagaataacttcaatggtgttcgtattactgacccataccaaatcctggaatactttgaccaatgcattgaacatcgtgatgacgtggacggaatcattgtagattccctgactttcatgatggatatgctggaaactcagtatgtactcactgctgcaaacactcagaaggcttggggtgaatttgcacagttcttcaaaattctccttcaggagaaagtagttaaatttgccaagccagttatcttcactgctcacgtcaaagacgaagtagatgagcgtgcaatggaactgaagactttcgttccagtaaagggttccctgaagaacaatggtattgaagcatacttctctactgttgtatcagcagaacgtatcgaccttaaagaacttgaaaagtattccaatggaatgttggaaattactgaggatgagcaagagttagggtacaaacatgtattccagactcgacctactaagaaaacagtaggtaaacgtattcgttctcctatgggtatgttcagtaagcaagagacttatatggacaatgatgcccaaaaacttctcgaccatctggcagagtattactctaccggtgcttaatctggttgttagtcattcattaatttaattaagtaggaaatataaatgagcaatttattcggaaatctggcaggtcaggcagctaaagcagagaaagcaacggataacctgggtggcggatttggtgcaaaagaatctgacatttatctggctaccctgaaagtagcttatgcaggtaaagcagcttctggtgctaacttcattcagattattgcagacctgactgaccttgatgggcacagtgctggtgaataccgtgagcaactgtacatcacttctggtactgaaaaaggctgcaagtgtacttatgaaaagaatggtaaggaatacttcctgccagactacactgtaatcaatgacatcttggtaatgacttctggtgagactattcctgaagcagtcttcgaagagaaagtcgttaatgtatatgacttcgatgagaagaaagaagttgccaaatctgtcatggttccagttaatgctatcggtggtaagtttgctgtagctattctgaaatctgaagaagataagcagactaaagatggctccggtaactatgtgtctactggtgaaactcgcttcactaataccatcgaaaaagtattccaccctgacttgcatctgactgttgttgaagcagaagaactgactgaacgtggtaaagagctgaccgttgaagaagcagtcttctgggacaaatggctggagaaaaacaaaggcgttacccgcgataaaaccactaaaggtggtgcttccggtaaagccggtcagccaccaaaaccaggtgctactaacactggtgcaggtgcttctgctgcgaaatccctgttcggtaagaaataatgcagatacctgtgcttggagttgaccccagttttcgtaactgggggctagcacggggaatgctcgacttagagacgggaatactctctggattagacctgaagctggtagaaaccaaacccgatggaaccaagcaagtaaggcagaacagcaaagatatgcaagctgctgaggacattactgctggtgtcatcgactggttcaaagaagcaaaggtcatctttgtagaggttcccgttggttcacaaagtgccaatggaatgaaatcctatggtgtttgtgtaggcatcttaggagcactcagggcactaggacatgagattattgaagttactcctatcgagaacaaagtagccctgtccggtattaagactgcttctaaagatgtgatgattagagcagctacaggattttatccagaagccaactggctcaaggataccaaaggtaggctgctcaataagaacgagcatttagctgatgctgtaggtgctatccatgcaggagtactcactcctgctttccagaatttaatgagaattttatcaaaggtataacaatgcaagtaatcctgacccaacctgaaatcgaagctgctctgactggttatgtaaacgacctgatgtctgtacgtgaaggtatggaaattaaagtaaccttcaaagctactcgtggtgatgatggtgctactgcaatcgtagatattgtccctgctggttcccaatctgttgaagtggttgaggaaccaaagaaagagtcaaaggaacgcaagcatcgtccagtaacccagaccaatactgctgctgtcagtgctctggcttctgctactggtaagaaaaaagaagaagtagttgaagtagaaactactactgaaactgttgatgaaactgtagaagtagctgaagaagctgctgctcaggaagaagaaaaagaagtacaggaagaagaggctaaagaaccagtacaagccaaaccttctctgtttgcaggtctgaaacgttaatatctgggtaaacggtggctacaaagctactgctgggtgtggtggtgtttatagttttgattcttcttattgtcagaattatagacgtgtcggctccatatctagcattcattatcaccgtcattatcttgtataagtgctgtggtagtggtggtgacactaagccgccaggtaattaactaacaagaggcgactggattactctccccagtcgcttcgttagtttattcaccgctcagtaaatacccgaataaagaaagaagttgtttcttgaaattagttactgcttgtaagagcagataagtttgtagtataactacgctcaaccaagatggtgtagctcagtggtagagcagttggctgttaaccaactggtcgatggttcgaatccatccaccatcgccaaatttggaaggttgtcagagaggccgattgtacctgacttgaaatcaggaggcgcagagatgcacccgaaggttcgaatccttcaccttccaccaaattgctggtttagctcagttggtagagcaattgccctgtaagcaatgggtcaatggttcaagtccattaaccagcaccaatacaggttattagtgaacacactatagaacctcccagcttcctccagatgtacggcaatacattagctggtagtgtgttcactgataggttgtactatcacagtccagacaatatctgcgtgacttaaaaaacagatggagccaggtggaatccctggcaattaattccggtgtaggtactagtgttgtgcacggcatgagtgttctggttcgagtccagacgccggaaccaatttgaaagaactcttattttggttaccgcaaaagaagtgaaaaatgttgtggaaaactacttcccaattaggttcgaatcctaaaccagagtaagagttctttcgaattgaagatttacaggatatagctcagtttggtagagcgtctgctttgggagcagaatgtcgtaggttcgaatcctgctatcctgaccaaattagtgctctggtatattacttttaacccctaggttatgccacagtaatacaacagattgggtcatctgaaaccagagcactaacctaatgtgtgggatgtaacagttaaatccagttgccggaagtgcaattctagatacgctgccaatgtgtgaacggtaaggctgtacaggactcggactcccatcccacccccttatttgaaccaggtatgaacggcttacttagtattaactgcataggggtatgttagggatacttaggtggtaagcagttggtaagaatccaacatggttcattccctattagcagtaacatagtcctgagtacgtgtgctctaaagacaatattggtgagacagtccaatagctgctaaattaaatttgtccattcctcttggatgtgtagcgagtgaaggtaacacttaaaaatccatgacccacagaagcctccggttaatcctggaggcttttttatttaattaaataaggaagcaagatgaaccgtattactgaagaacatattgatagcatcattgaaggtgcttactacttcaatatggctaaagctgtagagaatgaagtagttctgattcctgaagaccatttaaaagcattaagtacaaccactgtttgtgcactggttctttctaatggattcactattactggtaaatctgcctgtgttgaccctaacaccttcaatgaagagttaggtaagaaatatgcttacgaacaggccattgataaggtatgggaattggaaggctatctgcttaagcaaaacctgcatgagaaagctcagagccaggaaatgctaaaagagttcctgcaagatgacaactgtgaaggtgggggctgtaaaatctaatggaaattaaagttcactttactaattacatcggaaccaaatgtgtaaatggtttcccgatgaacaaagctgactactgcaaacttcgtggttgggttgtacctgctaatgaagacctgttagaagagggttacttagtagagtatcccgattctaaacctaaccatgaacaattccgtggttatattagctggtcatctaaagctgcatttgaagaagcataccgtgatgtggataaaggctgcacgtttggtcatgccgtagagcttatgaaatcaggttttagaatgtcccgtaaaggctggaatgggaaaggaatgtatatcaccttagtatccggtgaaaactgggctatggataaacatgaaaataccgtatgcatgaaacaggattggctgggtattaaaaccgctgacaatgaatttatgccctgggttccatctcaatcagatgtattagcagaagattgggtactagctcagtaagaattaaagcccctctagtgaggggcattttttattagtgggtaaggttgaaccaaggattgagggtaggtgctcttagtccttgtccgaagcctaatgaataatccagtcttccttcagccagcatggttaacatgttgtcctgaattggtagacctacattaccaaacatggcaggagcaggtactactgtagcaatcagagaatgtactgggttgtttctaatcatgctcatagcaactttaatggaacgaatcttaaagttgtagaaccacatcagacccatgctttccatataaccacggaaacgaccaggcaatctgtcatagttaataaactcttcagttacttgacctaatgcttcagaagaggatttcttcttacgtttcactaaatcatcatagatgatggctttagcaatgaagtccgaatactctactgttttctggataccctggaacagagcagtgtccttagcaataagagcataacggccagcattacgtactttttctggaagtttattagcaagtttttccatgtactcatgaatcttaccttcagctactaacaggtcatcacgactaataccagcatcagcaatagaagagaactcacctgcttcaatcaaaggccagatgctcatacgacgatggctatcagtaatagattgaatctcggttttaagtttacgaaccagattaggattgccttcagcagcacgtaactctgcttctgcatcaatctgacgtaaacgagatttaatatactgattaatctctgacgtcttacgaggaatgttcacagcaatatctttaacaggaacaccacgtccaatcatctggtagatgttagcaaggaagttaactgccggtactacaacagatttaacaacaattactgtcttagcatccttcaccaagttctgaatggtattttcagcattcattactacatgatatgccttattaccaaatgcaccgaggaacatcttcttaacagtatcaagggtgctaggtgaccaacgagagttaccagtccatacatcaccaatagatgcagcacgatagccaagtgcatcattcagcatatccctacgaacccataactcatctttaccaaaaagttcttcagccttatgacgagtctcaatattcatcaggttaattgcatcagccagtactgggtcatcaattttacctaacaggtttacatattgagatttattagcactagagtctttaatatctttctcatacatagcatgtaattgctcaatgagaacgtcattaaaacgttgtgctttagcctcttccacctgacgaccacgccatacaccaaccatcttagcaaaatgattgtcttggtttagatgcttcaacatattagggtcaacggattgctcataagcaactacctgacctttgctgttataaattggcatcagtggttcacgcccacgttcacctttagccagagctttggtaatacgctctacggttggtttgtcagtaatacgaccagcaaccatagtacctaacgtaaagccagtaccaatatccactccaccagcagtattacgaacgttctgaagaataccttgagagtatggagcacgggcagctactgggctgaagtaataacctttagaaccagtacggaaaccagtgcttccctgataagtaccaatacgagtaaaggattggctatttaacttagcaaactctttatcgtcagcaataatcaaattcacaccttgctggttctctacagggatatagcccttaaagtgattcagcagagtacggttatcacctttagctttacgcatctcttcagtacgttgacccaccatataagcaatggagaactccataccttccacttctgattgagccagttctgacaaaaggtcacggtcagacttattcatcaattccagagagtacaaagtaatgagcttatcaatagcaactacatctgccacaggaccattagtaatacgttcacctaacaaacgactaatagcatgggcattacgaaggaggttattacctacttcccctgtaatcatgtattgagccagttgcttagatttcttctgaaccaggttccagtttctacctgcttggttctgaatctctttttccagagtagagatttcatctttcactttcttggatgaagagagtaaatctctaatttcagccatgctcatagtttcacgtagaacagctaaatctgttttacccaaaccagtatgcattgcagaccactcggtatcagtcagtttacgagaaaacttaccagcaatgactgtaggtaaatgctcacggaattgttgacggtcttgagaaatctggctcttaaccaatttgattaaatcatagacattggcattagtcttagtacgaccaacaatgtcattaactaagtcatggaaaggttgccatactttaccctggttcatagcagtcataacaccctgagctactatttcaccctgtttttcagatgcaatagcagcagtcagtttagccagatgagcaacacctttagcagctacattagaaggattagcaattaccttatctgccttctcaataacagtttcagataaccgttcaatgctatctgttacgtactgattagcacggtcaatgaagttaccggtaggggttgctacagcatcatagaaggactctcgtttcagagcagcagccatgattgtttctgacagagcatcaatactgtcctgaacattagtagccttttggtcaccagccatgcgacggttcagagcttccattacctgagtacctgcattggtaagcagagtatctacatcatttcctaatttcttatctgctttaggtacaggcatttctttaatgattgaacgtagttcttcattaaccatagccagacccaggaatgtaggtaacagactggttctacctttagcatctacttcaaccagattagcaccagagatagtgtcatatttctgttgagcatagtaacggtcagcagggttagtactatcagggtcagccatgaaatgttctaccgtaaggtgtttcattacatgggtataaagttcctgagcacgagccatagcatgtgggtcaattgcagcttcagttgctaatgcagcagtaaccatctggaatacagattgttcctgagcagtcatattgaaaccacgagactgaacatcacgaaccagtcgagtagcactcattaatgcattagccacattgccacgacgttctacttctgtaactgggtcagtacgaaggtaatcagttaccagtttatcgaaggtctgattcaactgagacagacgttcattgttaccatatgctttgctatggaatagtgtgccatctttagctactgcctgagttgtaggttggctacgcatcagaattgcagagttaaacagcagattagagaacatatcttctcccaatgcaggagcttgtttacgtccccaaatcaatttcttaatagcctgataaacatttttcaccatttgaaccagtgaagatgttctcttctgtttagcagcaagagcacggttagctaatccccaagccataaactcattaagagcagcagctttagaaatagctgggtcaacaaagccattactcaaatgaccttcaatagttgcaatagcatcagcatatgcttctctcatttctggagaatctttggaaatatccagagaacggaactgttccatcagaccttcaaggttctcaatagcttgcttagaagtagggcttacttcattaccctgatagaaggaataaacttcctcgaaggtagaagcatgaaccagttcatgaatgagggtttccatagatgggctaaccagataaatggtcttatcgtcaaagttagtccagccataaatattacctgcctgagcttcttccatttcctgagaagtcaattcagtaacattcttctgacgagcatactctgcaacctgagtaggtgtaccgtagataatcttatagtctttagctgccagtgatttctgaatctctgcaagagtagctgcctgagtagatggcagattactaatcttagccagattacgaatagcagtagcagacaggatacgaacaccggatgccttatgctcacggcctaccataccaaagtctggattcactggttctttttcagaaacagtttcttctttgacttcagccttagccttagcgactttttgtttacgggcttctaactcttcacggaaaagtttattcagttcatcagcctgctgttcaggagtcatattgctgaggtcaatcttaccgttgttctgataaggagcacctacagcagccatctggtcaatggacagatttaccttatctagtaccttatgacgaatatctacacccagtgcaatattacgtaagttacgttcaatcagagatgcagcattagcaatatcatctacagtagcattctcccgttggtcatattccagagcagatttaccaattgcttccaatgcttcaggggacaacttactgaagtctacattcttcatgaacttagcatatgattcgtaaacattcttaatagggttaccctgccaagaagtgtaaacagcttcattagccttacgactagcatcagtgatgtcattcaaaccaatgttcataccatcaaagattttgagggtattctttggtgcacctttcatagtagaaagagtttgcatcatcatgccatcaccagtaccaatagtcataaatggaatacctgctacaccggcctgtgctggagcatagatactcattggtacacgcatacggtcatcaaggttagtagctaatacttgatttgctacttctgcattttctgacccagcaatgtagaaagtctgagaaccagtctcaatcataggagctaagttattcagggaagcctgaatatcattcagttctttctgagtaaggaaatcacctttcttccatgttgggtctttagccttctctgccagcttctcctgtactcgctgtttgaacatatcttccagcactacagattgaatctgagtagctttctgtaattgttcagtggagtacaccagactttcacctacagtctgagtaataccattacgtagtggttctacgaagaagtgcagcatattttcctgaagtgccttcagttgctcacccttaatggtataggtcttaggattgattttccctttggctcctgcacctgtggattgtagttccagtacacctttacgtttaacaggaacagtagaagtcagtgtttccatatctttcaggaaacgagcaagaagttcttcagcatgtgcttctgaagcagcttgcttaccaaacattgccatagcagcagagatgtttgggtctttagcacgagctttcagcacatcagacatacgctcatagatggcatcagtaacagaactaaccaacttacctgcaataccacgagcacccgaaccatagatggtaatagtcagggggttcttagcaataccacgtttaagttctaaagcaccattctcaccaagattaatatccggtaggaacaaatccatcagagaaagaagactgtctatctgggactgaataggcatattagaagcatagttactacgtaacttacccaacgattccatcagagcattagtggatgcctgatataaatcattattgtcagcagtagagcgatgctcattcatggtcttatttggagaaccaatgaacaagcctcctttggcaatattacgaatccagtcaggagtaaacagaccacctgtcattagcatcatggcattgattggaccattagtaacaccatctgcttctacatacagtggggttacaaatgcagatttatcctctgctactaagtaacgggaatactccataagagccatcaatgctacgaatgacttcctatctcctaatgctgtattcagaacatcaactgcattttctggtaaggaaccagtggtattaaactcaaccatcatatcaatggccggtttcagattaccttccagtaatttagtcaactcgtcagacataacctcacgagtcatagtatggactttaatgtccaatgcctgagccagacctaactggaatgcagagaagtcttcattgttctggtttgataaatccaaagtagctttagtaggtaagatagcctcacgaaccagtttggctgattgaggattatatttacctaacatctgcatacgaccaacacgggtcatattgtatgcatagtgaataggcacagtagagatgtcttcgctctgtgctcttacctgctcaatgacagagaacagttggttgtaagagtcctctactgaacggttcttaccttccagagatttagcatggttatcattaagtaactctttattcagagtaccagcacccatcagttcgagaatatggtctttacctaacgtctcatagaattgaaccattggggtatgtacatagaactctgtagcctgctctgctttcaatgcagccttctgttctggagtattacgaacagcagggttacgaagctgagtattagctacaggaggaatgtcatcaccaaagaacatcttctctgtaggattcactaaaacagcttcttcaatagcagtagggaagctattaattgggtcgaaggaatccagttcagtaatggtgtacagaccaatagtcttcttgttatctgggtcaatttctgacatatccacgatgttctctacaacatcagtagactctacaaatgcagccagaatttcagcagccattgctgtagggatgcctttggtatagcccaatggagcatttggattacgagataatccccagtaagactcaattttctgagccagggaactaactgcttcggtgagtgtcataccagtatcaaattgctctactaaaccttctggcagcagagcttggtcaataccagtaatagcagcaacatcttttgcatctttgatagcagtattgctggtagcagtaagtctccattgaagacctgctaatacagcagtctgtagcaattgctcgttgtacttaaaggtatccccatcctgttcaacgatgttaagtaatttaccacctacccaacggttggcttctgtaccttgagcaaaacgtttaccaacatccttagtgttaaggaacttagccagacgagaacgaagaatatcagcaataccttccccatgttccatgagttctttgtatcgcttaataacttcaccattaaaagcaggattagcaacttctttctcagtaaagagttcataacgagcacgggaagacagagcttgagctaaatcttttagaggtgcttctgaaccaacagtacgggatttctgttcttccggtaaggtaaaggacaatttgaaatagttcttaataccttctgctttagaatcaggagtacctaccaatgaaggataaacagcatcaataccttctcttaattcctctgtaacaatactttcttttgcagaaacctcagtttctttaacagattcagtgggttgcttgatgttgtcctcattagtaaggttaacatcctgtttttcagactggttcacaggttcttttatagcctgtgggctagactctttagtagtaggttctgttttaacagattcactaacaggagtcttagtctgtacagtagatgtaactggttcctgttttgtaacaggagtttctttaacctgattcacggagtcagctttcggttgagaagaagcaacgtctcgattgccttgacggaatgccttgaccacctcagcagcaggagcgttaagacgtgaatccaatggagtaacttttatatgactgaccttcagttccgggtaagccgaagcgagggcattagcaatatccgctaccgttttcgcttcaagagcaacttgctgggcaaatttaaccgacttagtgtcatagggattgacccccaatccggtacggctacgaacccattctctgtcagcagtaagagcttggtagtggacagacttattcttatccgcattccccgtaacaagatgctcattcaacgctccaaccttattctgcatgtgctgggcgaactgcataaagtcgttcaggtaagcggaggccaactcgaaattaccagagttatacgcagaccgaatcctattcgcatgttgcaacgcagagtattgtccttcctgagttctgctctcatccgttttaatctgtttactcacaatgtcttgaggacgtaatccaagacgggcagcttctgcatcatattcccgtgcccccttcaggattgcagcagcattctggagggcagcaatctggcgattattcagtttaatacgaccatcagcagcatgtttaagaacaacatttacagactctggattgagcttttcaggagctacttcagcagctaatgctacgttctgcatttcctgtggactggattcttcagtcacattcaaagaaccattctgagcagattcattaatcattcgattaataacattcagtgcaccaattacttttggtgtgttctgaatattagctgtcagattcgtataacggttgagtaactcaatagccggagaatctttaggaatgctatccagtgcagcagggtcacggttaatgaactgctcaaactctgaaacagcatcatacatataagatgcagcttccatcagtgcttgaggattagattcatctaatgtgttaactaagtctgctaacttctgaataacctgtacttggtcagtagagccagctacagcattacgaatatgctctggtgcttcctgataattttcaggattaaaacgagtagcattcattaagtcagaaacatactggtgtgctgcaactttctgttctggagtagcatcagttgcttcaacagcatcacgaatagtaacttctgcttctggtgcttgagccatagcttcttgtgctgcctgtgcaacatagtcatcagcaacaggggatgcttcttcattctgcttcataacccgttcaccacgagctactaaagtatccttaataggggaaacaaccttacctgctacactgccagcagctttaacaccggccattgtggtacgcaatacaggagcagttgcagcacctactaaacgagcagcaccagccggagcctgtacaacaccagcagaaccaaagccataaagagcacctaaaccagcttgtgtaccgacacctttaagcaggtcttggttcttatcaatgttttgttgctgtgcaatattctgagccagttggcctgtagcaccctgaacaccttcttccactgtttcacgggcaaggttcatacctacagcacctaaagaaccagcacggaaaggagccatctcaaaacgagataccaaaggaccagttgcagcagcaataggtaattgaatagcagcagcagtaagaccagtttcagatgcagtctgacgacgagcctgttcaggggacataccatctttaatatgttgctgataaacaggagacttctctaagtctttaagactcatcttcataatttcgtcagcagtttgttggtatgcaccaccagcttccattgcaccaacaccaatcatacctggtgcagctctgcctacagtagaggcaatacgagccagtgactgagtaccagtacctgcatcaatagcaccagccaatgcagcactacgaagagtatttgctggaacaactgctttacccagtaaagatgcaccccttaatacaggaccagcacctaatagagaacctaccccttccgctaacccatcagaaataatagagtcagtttgagcagcattctcaattgaacctacaaaatcacgtccaaatttagataaggaagctactatgtcattagtgccttctttcttatctgtttgatactgacgttcactctctacttcactcattaagttacgagcagcaaagagcttacgtttatcttgtaatgcttggctttgggtagcatggacagcatcattaaacttactcaattgttgagcaacaacagcacttgcatcatcgttgagtaagcctgccccaagagcaccaatgcccccaagggtattaacaaaaccaagaccaacaccagtagcaatatcccccagttcttccccaggagttcttgtagtaattgaatcattaaatacctggttccctgcatcagcacgagcgttgataagttgtaagccttgctcaaccccatacttattcatgatttgcattggagtcagattcatgaaatctgattgcactgtccctggttcaaatgcattagccccaacattaccagtacgggcagcttgcatttgataagcagcatcaggagaaacaagaggagtagtgacaccttgttcagctttcttctgggcggttgcagtaaagacgtcaacttgctttgcattggttacgctgtctgcgaacccagccagtctatcaaatactgacatagtaggtttcctatacaaacttatatctattagaaatcacactatacctagtgtaaggacgagaaaaaagccccgaagggcttttgtattatggtagaaattaacgaggaaatatatcagggatacccaatcgacgcccggcatctctgcctaaacttctccggtttgcctcgctctcttcctgtttaatattttgtaggctcttaatgtccaaattctgagggtcagcagctacagcactacgagcaccatcaagaaggcgtttagcagtattaactcgctcctgatagcgaggtagtacacttctaaggttttcctgaccggtctgaatacgacgctgtacttcacgtaaatcagcaagtgcagtatctaacgtattctgtgctgcatagatgtttgattgaatttgtgcagtaagctgattacgagcattctgttcaatagcagtaccagtagttgcaagttttgtatttgcttctacggctgctttatccagttggtaatcaccacccaaatcaataacatcagtatcaaaggcatttcgaataccactaaaccatccctctggtttaccggtgatactacgttgaatgattgctcctgccatagcgggagaaatagcgttctgttttgctacctcattgatttgtcgaaccagtgcaccttggttaatacccttcaattcattgccatcaataatacgtttagccacctgaccagtagtagaagggtcaacagtagcagcttggtattctggcaacagagtattaccaatattctgcatattacgagtaccaacagtattaccagcaacagaagtgaatgcttgttcctgtaatggattaatagaattacctgtttctgcttgagcaatgtaatccttcatttcatcccatgacaagttcttataagcaccaggagtatcatctggtaaagcagcccatgtactcttcagattgccattcttacgagcattaaaaatagcttcacccagtttgtcttggttctctggggacatagggatgttctgccaattttcaccaaatacctttggagcaaagtctttaagggtatcttggttaatctggtatgcaccaacaggagaagcacctagtgtcttcttcatagtgtcttgatgctgaaccacctcgcctaagttcatctgagtaataggtacatcagttggtgtgaacttataggtagtgtcatatgcagagccattccgagtaccatgagtaccaggaggagatagaggtgcagaaccagttcccggagtatatgcacctgggtatgccctatctaactgagatagagcacgacttactgctccaggtgacatttggtcgaacgtaccctctgcaagcatacgagcatcgtcagaactgtatgcaccacgacgaatattattcagtaactgcatagcagcctgagtatcagcatcgttacgcatatcaacacctaagttgaataagctacgacgttgaccaataccagcagtaccctgtccttgaaggttgttcatgtagtccataacaataccagcaggaagggtttttaatacatccccatactgagcctgtgctgcctgaacctttcttgggtcaccagattgataagccagagccaattcctgtaatgcaggggcagcagcatcagtagctgcatttaccttcatggttctgtcattactgtatcgagtgaaatccagattttgttgtttagatgcttggtctaacagattgccagcacgattatctaagttctccatagtacgagaagaaattagagaggggtcgtagccagcaaataatgctccagaggctaaggcattacgatactcattagggtcttggtaacgcatggcttcagccataattgcatcaccagcttgctgtcttgcagagtcacgaaaatcacctaatgcattactcaatccggcagtggcattacccagcatattggagaaagtacggatactatccccgacaccagagaaagaaggagcatcaacattacgccatgtaatttgagccatgtgatacctcttaacgagttaagcgattagctgcaatgtaagcatcagccgtagattggtcacgattttctgcaacagcacgactacgagcacggtcttccagagcagtgttataggacttaatctggttattcagattagtgttagtaacatctttagcaaaagagaactgattcttagctaacttgttagcctgtaatgcaccatagatattacccagtgcattaagaccacctaaccccaactggaaggtgggaatgttcagacccagttggtcagtaagcccctgagtctgcccaccggtattccctgtagcaccaccagtaatattctgaagccagtcattactaaggatgccggattgcatagggttatagttcatggttggggtattaaaggaaccatacccatagccaaaattactttgtgcagatggggttccaaaaaggaaattagtatccataaggattctcctgttacgtatctaaatcaagctgcaacgttatatctgcaaagttggtaatcatgttgttagacatgtcagctatatcatgaccagtcataagagtacggctaagaaatgaatccagtggttcaaattgttggcctacattagttaggttcattgggtcaatgtaacccatgccctcagtgccaaacatttcctcatacttttcctgaatggttttcatctggtcacggtactctgccataagtttctctgtctttttgacagtttccatagcagaagcattgatgtaatcacttatgccatttcctacagatgaagtaagtttaatgatgttgtctgctttcatcatttcacccagcatcgtagacatggatgaaccagtggataaagctgtaccaacattcatggctaccatagaggcaatagtagcaacaatgattccaatcttatccccaagcagactaacagagactgtttgaataatggacatcagaatcatagctgcaatggcattagccacagccccaacgataatagcagctaaccctgcaaaacctaatgcagcaccaatagaagcagcagtacccattaccccagcaccagcagcaggagtaaagaacacagacactactactgcaacaacaaccactactactttaaagatgccagactgataccatttcttcttaactttcttatatgagttaagaaccagataacaacatgcagtagataactgagtaccatttaccaaagacatactacgataaatgttgttatgaagcgggatgataaatccggactcttcatcatcatttagtgcatctacaccagaaatgcttacagatttattcttgtaaacattattgttatggttcaggccatagacagaaatcttcctccatgaattatccccatcctgccaatacattgttatcttatctagcctgtagatagtaaacccaactttgtcattacccttttcagagtacataacggctttctgcataaggactacagtaccttcataagcaaacttgagctgccctttcttggctccagagaatgctttacctgaaccaactgattcttcaatgaagttccaactaatagtcatgttgtaacggtatccaccgttagaacgaatattaatggatttagaaggtattgttggatatacaggtcttttagggggcttccctatgggaatatccctattaccactgcgagatttccaccattcctggtaagcatcaaagtccctgttagcctgagcaaagccttctaccaaagcacccatagttgggtagtttgggtcagcaggcattgactgattcactaactggaagaatctgtatatgtactctttagctgtattttcaggactattaagagaacaaccaaatacagcatagatatactgaatatcaccaatatctttgttcttcttcaggtcatccataatgtcagaaatcttaccccctgtagccttcttaaaggctctcttacaaagagtatacgtagagccagaaatccagttcttatcactacggatagggataaatgaatagaatctgttattggtcgtcttattaataaacagagcatcaaggatggcattaccactgttctgtttataaataaacaattgaggcataccaccagcagacatagtagtaactacatctgtattctgataagaccatgtataacctaaagtatctttagttactgtagtagttctggtttcagtaaccccaccgcctaaatcaataacttcggtgtttgtagtggaaccagtggatacagtgccagtctgtacctgggtcattgtagtcttacgaataatgattaagcctacttcacttggttcacgaaattctttctcgtaaccatctgagaagttagtccaactaacctgttcttcttcagtattggtactttcctcatcaggtctaccatcagagaatacactcttaatatgagtaactgtcttcagggtagctgacttaggagtatggttctgagatacctgagtccattcagaagtagaaggtaaatcatcagcagatgatacagatacaacaggatgaaccactgggtctgcaacactagtgggctgtatgtagtaatagttcacatacaaatacattgcatcctgactgtaattctttggataaaaggataactcactaccatcagcagcagtgagtacaatcctgtcatcatccatgatgtctatttcaaactcttcagtaatacggtctggataattctcatagaggaatttatcagcccattcctcaaaatcaccaaatccaatcctactgctctgaacctgtacctcatagcctgctttttgaggaacttgccatttaactacttcagggtttacctgagacagtattgacaagttcccataagcaataccaattgaagggtcatagttagttgcagcccaaccagggaatctacgtaaacgaataccaggtccatttaaataagagtcagtgatggtatcacccatactaaagtcagatttactgacgatgttaccaatcactgtagtctttaaataatttgggcgtttatgtatatcccctgccaaattgtagacagaggatgctacgtagattttagtcttactgctaaacagtcccatgtattaccccaatgcgttgttattcttcaatgcagtaagaatgctatccagactggagttagtgaagccattaggaggagacagaccctcatcaatggttttctgagtgacccatgcatcagtaaacagtttggcagctttaacttcagcatcacgtttataagacgtaatctgttggtcatagagttctttctgtttacctacagaaccagctacacgagtaccatcagtacgagtatcagaagtctgagcacgttgtgcttccttctgctctttcgtcatattgatttgttcagtagttaacttagtctgttcagcaacctgagtagtctggttcttcaacatcagtaattgttgaggaagcatagaagacagattgtattgagcagtacagtaagttactgactcattagacagcttcagcttagtaagggcatattcagctttagtagccagagcctgaatcttagctgtaacaaagttagctttgataataccaagattagcacgagcagtaattgcagctacctgagcagtaacagcattccaataagcctggtctttagtggtgaggaattgcacagcattagccatacatgcttccatagtagcaatgtatgccttaacgtaatcaccaccagtaattcggttattcttaaattctgccagtagatgattgcttgctgattgcattaaagcatcaaatacaccagaacctccaacctcacgagtagttagttgttctgtggttatcttctctatctctgcatagatagggctattaatgccaccaggaatatcatactcactgccagacatgtcgatgtcaggaagcgtaaaatcctcacctgctacaagagcagtaagtagagcattagcttcgagttcagcaccacatgacatggtatttcctcattggttcattaaaagaaaacggctcacggttttacccagtgagccgtgctgacttacagattaactcttattgagagtctacgctaccagcagcaatctgagcagcagccagagtttgtaattcttccttagtcaatggaggcagaacttcaatggcaaactcacgtacccatgcagacgtaatattaggctgaccattcttacctttggtaactcgaatgttcaggaacttacgttctttgaggaagttataaatacagtaagggatgtgataaccctcatcagtagcttcaccaaatggaacgaatttacgaacagtaccaatatattcattagctactgtaataatctcaccaggcaggtctttcttcttagggtcaaggttctgaatacgtactcgaaccagctttaattgttctaagcgttgctggtgacgtaaagaagttgccgtagttactgtacctgtagacagagccaaaggattaggctgaggttctactggttcctgagctttattttcctgtgctgcttcaatcttcttacgaagagtttcagcactaatattatttgagtatgaaatacccatcatattagctcgttgtttcagcagagaaagttcatcaaccttaacttcatcaacggtgtcatcgttgccctgagttaaatcagcggtcggtttatcgttaatgctcatgtgtatatatcctattcataaagtaaggggaggtttccctccccctgatgttagcccaactattacagcggagctacagttttaataagagccagacgttctggacgtttaaccagaataccgtagtaccatttgatgctggagaaaccagtttcaccatatgggtcattacggtcagcagtttctttaccaggcattttagtcataacggtaaatttaagtgacttaccatcagtctggaagccaatggaggtaaaggaatcatcacctactaccagcattgggtaaacgtcatagtgctcctgaccggataccatagaggtacggtaacctgggttagctccagtagcctgtgcaccagcacctgcccagtgcagcatttctggaacctgaatgatacggaacttatcaatagaaccgacttcaccattcatgatagtacctgcatcagcatagtgctgagtttcgataaaggctttattaccgaacaggtctttcattgctttcagttttggaaccagttcagaacctacatacataacacgagtagcaccgatgactttagtatcaatcatacgggaaccagtgataatagtagtctgagtaggagtacggttctctgtcagaatctggtcaagacgcatcaggttcttataagaaactacagacggggtagaaccttcaccagtgatggttgcatcagaagtagcagcaccagcatacagaacagtaccagcagcagccagcaggtctttttgcagtacagcttcagtaatctgagtagcaccattcatcagttcacgggacaggtgttccatcaggccatcatcagaatcgaagtcaattgattcctgagtgaactcatagaagaagccaaacttgtgaatagaaccttcacgagcaatacgagtaaaaccaacacggttaactcgaccaccgttttcagtcagtagaggcagtttggaagtaatgttaccaatatctttgctggaaccatacaggttaccattaacgatggtagcaccacttgcatcaataccctggtcattgatgttacggtcatccagcagaggaacatattcatataccttgatggtcttaccgtaatgcttcggcatgttagttacagaggccagtggcatgaagtactgctctttacgggcagtgatgattgctttcttcagccagaagaaggtttgcatctggtcagagttagcaccatcaatactagatttctgaccgtcaataggagcgttatagttcaacatgtctcaattccttataggccgttcagccgaggtagtttcataaagtcctcatcactcattgcaagaggattaacaaggacttctgtcttacgcggtgtaacccgtgatggggatgccgctgctgcctgttgagtattagtgatttcagacttaggagttgcaacacgagttgctactggctgaaccactggcttaggttgctcaacaggtttctgcttaatcaaatcattaaaaccaccattagcagcaaggtagttaccgacttgattataagcatccaggaatgctgtaccgattgggatttggcctaagattttgagtcgttcaatttcagaaacaatacggtcgtaaataccgttagctttctgttcaacgatggtattaaccagaccacgattttccagcaatgcctgtttgctgtggtcatcccacgtagtcgaaattaactgaagagtagcttgtccttctggagtggatttagcatcttccagttcggttgcaaatgctgcttcagcatctgacacacggtgattaccagcttggtatttaacttcctcttccggattaatatccagaacatcaataccagattctttaatcaacttcttaatagcatcaggattccctttaactaagtcgatagcataagagagttgcccttcatctaataatccgttgttttctaacatcaggagatacttacgatacggctgaatctcctgcattttacgggtatagttagctcccatttgcatcaagctaatgacctcttcaggactctgaggagtaatcattttgccgttagctttaaatggagccattatccgttcataaccagccttatagtcgaagtcagttttctggtctgatacctgcttgtcttcttctacttttgcttggccttgctcagtagtagaagatgcattatcagtagcaggcttactgttgctgtcaaccttatttgggtcaactgtagcactatcattaccagttgtgaatgaatcagaattgctttctgattcagaagtattttctacttcagttggttcagtagttacttctgtttcatcagtttgttcaacttcaacaattgggtctggttgtgcaggagtattattttctaccggttccgggttgttctgaatgcttgttggaccaggcatgttcagaatctcttcatccgacattttaaaaatgtcggaagctgtttttgcagcttccgtagtcatgggagtatctccgagttaggattaattaaacttcttcaggttcaccacgagcaacatccaatgcattctcaatatctgattggacacctaccagtgtttctgctttctgaagagtaatttccagataacgttttaaacaaccagcagcttgagccatagcaagagcatcagcacgttgacggtcttcaagtaatgggtcacaggattcttgtacataacgagcacagtctacagtacagaattgctcaagaattactttacggaaaagggaattacccatcagcttacgaacatcttctgcataagcacgagcagctttaatacccttcagttggtgttccagtccttcaatttctttttctttgctgtacataattaattacctaatctaattcctgggttaagagctgggtcacgggttgggtcaaactgactggaaccaagtgaataagcagggttggcttcagcagctatatcccgttcagatacagattgaatacctgtatcctccccattagtcaatgcattatacccaattgcagcagataagttagggggaagttctccttccttacgtggcttggttaatgctttagtaatttctaattgctgattaccttgtgattgagctttcatcttctcaaggtcacgagcatgtttagtgccagattcttgttccagataatccagattcttattgtctcgttctgccatagctttttgagcttgtgcatcattaagacgaattttagaacgtaactcttcattctcaagctgtgctttctcaacagccaattgtttgagttgttcttgtactgggtctggttgaggttgccatgtacgtaaatcatgagccagtttaggcatacgtttcaagtcagcaatctctgcaagaatattcaaagtgatttgctggtctacgtttggaccaatagtctgaagcataaagcctaagtcttgggacttttggttgtctacttcagcagtagaaatatctacttcaaggtcaaaattacccttcaagtcctcacgtttaatagtgacaaactcttcattggtaatacgtactacttcatgctctgccaagaacacagcattcatagcaataatcttattaccaatttcagacatgcctttagctaaacgacgaagaatagccatctcacgtttagaagcagcatccaatacaccacgaataccggcagctacatcaccataagactcaccagttaccccaccagcaaatgctttaacaccagtaagagattctgcttcctggttctgaagagtagccatagtcagtgctgattgaggcaattcagggaacttatgctcaataatcatttgagcagggttttgtgtaggattgtattcataatcctcaccttccctgtaacgacgactattcagggcatcaagcatacctttaggcataccacgttgaccattggcactacgtccaagtaagtcaatcatcccgcgcattacagcaccaagtactgcttggttatcacctaatagctctgcatctggttcgccatacatatcccgtttaacaggcatatatggaattaatacaaatgggagtttgccatcaggataaggattcttctctaaacgaataagagtagaaccaatccaagtagcaacgataggctctaataccccattcccttcaatatcccagaacccccaatattcataagcaactacacgcttacgcatagggtcactaatctgaaattcttgaggagtagtagttgcatggtctggttcattaacaggagcagagctttgccaatcaatcttatttagattgtgataacggtctttctctttaagcaggtctgccttacaagtttcaaaagagacaatggcaaacattgccttattaatatcaccctgacatgaagggtcgataataatgttctctgggtttagcatttccaccgtaggatggtttgctaaaggaacttcaacttcagttatagttgtcccagtttgtactgcatatgttgcttgtcctgtttcatcaaagaaacgtactgattccttaatagcttcatctacattctcttcatacccacgagggttgtctgtacgaagttgtagggcttgttgtaaagcatcagcttgttcttgtgtttgaatagggaacaaactaaatacaggaacttcttgcttctctttacgaatttccctgttccaaccaacacgaacaataccagtaccatcatcaacaactgaacgaacatagttatcaatgaaacttacacgatttagtttggtacggaattggtagttaagaaccagttcattctggcgtgcaccttgtacatcttcccaagttacgggagtaactttgaataatttattggaaccaagaaaaggttcagttaaagcagagtaacgccattcagcttgacgacgtacaagtttaggctgtacctgtgaacgccctttgactttaggtggcttggctttgccttcaatacgcataaggtcattccattctttgaccttaatcatcatggcagtatgagatggttttgctgcatccaagtctgctttaagtgcttgcaaggaaggttcattcttccagctagttaacttagtagcttggcttgggtctggcaatggaaccatagaatcagtgttttgttccatagtaattcctattcaaacagtttacggtcagaacgaatctggttccccagttcaatcagttggttatcacggagtctaacagttgccctgagttcttcaaccaaacgtctgccttcttcaagacttgagtcgagtctggctgcatggcttgcaagattgaggcattgagtggttccggttgaggcttgacgtttataactctcggctcgtttttctgactggagcaaccgactattgtactggttagtaatagaatcaataacgacttcataagactctttggctttatcaagtcgaagggtaagttgcccgacttcataactgtgttcccgattcttttggtcataagccagttttactctatcaagttcttttgagtactccttcttatcttcatcccatagtgcttgaactttcttttcaccatgttgtgaaccaagaagaaaaagggtagctcccagagctacccctcccaaaagacatacagttaacttaattaacgatgtcttcattacacctctccagagggacattaccaatacgattagcaatccatcctgtagtgtactcaggcatattaagagataaatagtagtttaactgtttaccatccagagacttcaaaatgagcttacaggcttctactttgcctcgtttattctgaaggctcttatatgcacttagagttccagaaccgactttaccatcaacttgtattttagggtagtctttgccatttctggagaaagcattaagagattcttgtaaccaacgagatggtcgtgcaggtccagtattaacaccagcatctactagtttttctgttaccgctggtgatacatctgcaaacttaacaaaaccaggcttcaaaatgtaatcgttgtaataaatacttgatgccatttcctgagttaagttcttcattgaaccatcccagttatataccgactctagctcttgcttatgcttttgggcaacctgaatagttacaccatgattagtttcacctcctgggtctttggggtcattaacgtatccaccctcaacagcaaatacagcagcaatgattgctgcaataactcccccaacaccaccaactttcttcttacttattgccacaccaatcctcctttggtttcaaacgaaccagtcggcaaataatattcagcacaaagagtgctatagcaatgttattgccatgtggaatatctttgaggatatgttggggtaatgcagagaaagaactggataagacatccacacaagagaagaacaatattgctaatgtgctaatctgaatagatgcccatttccaacaacgtttccaattaggaaccatttccacatgtttggttaacttgcgaaccatgcaaaaatctcccgtctggcagcagccagtataccaataatgatacctgctccagcccatacccatttaccaaacaatccagcaccaacaactttatgtttgatggtaatgaactcttcaatagtaggggcagactcagccagagacttttctacattctctagtcgagtgtccatcttattaatagacagttgaaggttacgtacagcatcatctaaatcttgccgagatttagcatcacgggcattattttcgaagagtgtcttcatacgttcctccattcgagctaggagcacctctacggattcatgactcatgctaaatccttatcgaaaaagccgggtatccccggctctgttagtcctaatgaacagagagtgtgtttatacacccgtcaaatagtaccgatatttactagtatcatccacatactttaggtacggcataaattacaccatccctcattacctgcgtgtatgaccacgggtagatatgtgggatacctgcctctagtgccaatccccaagccttatcaacatcagcccagattttcttagcatcttcaggtaacagtacgaatcctatgaagtaatgaactacattcaatggataccctagtctattcacggcagcatcaaatgtcagtggaaccaggtcaagtcttccatcaataatccagtcatagtcttcaatctgaacaaagtcatagttagggaatatccattctgactcagggaagtttaatcgacctgttagttcagatgcaggggacataatctgtggcgtaaagaacagaagggttgcctgtgcatcagggaacttaccttttacatagtcacgtatgtagttagtggattgacccagtttggtacatagccaatctacataaggccattgatgttgttctactggggcaaagatgtctttaatccatggagtaggtacatcattacctgtctcttctttgtacaaagccatagtcttagggtcatagatacaaggagcattcttaccctcacctgtattatatgaaccatcccaccaccaaggctcaccaatctggaagtacagctccattcccaagttctgacattcttttagaatctggcattgggctttacttacaaaatccagagcatctttgttagtaggctggataaaactagatggtggataccaaccggaaagtgctgggtcacctttccagttaagctgtttccattcatcaggcataaagaagttaagaatttcataagcaacagagttaacaaacttcatatcccgttcatgtaataaagacaggaatcgtttataaaactccatagtaggcatgttaataggttcaggttcagacactgggtctaatcccaaacgtccaacaaaccaatagtcatcatgctgtttcttaacaggacttactaatgggtaaacaggaaccagtttaagaatggacttagcaaggtctaaacaaacctttctagaagtctcaacattgaaatgaatctgtcctattcctgattcgaaggtaaagttatccggcatgtactgtgccgtcaacgctcccatatggacgtcagtcatctcattaataagttgagattgaatctccctaatctgctctcgtggaacagttgtaggggaataaggcatcggtactactgctgcattactcataatttaatacccccattgctgggggttccttgttaaagagtggctgtcatatcaaattgtttagctacgttagatgccccatctgcacgataaggtcttactcgccaaaccatatggtcagtcaggtaaccatactcggctgtaatttcttcagccgtccaagtgattgtaggtgctacaacaatctctattttaacaacagtagagttctcagcattgagaatctcaacctgccattggacagcatcacctacttcccatgacatagtacagttacctacagagtctttcttagcaaagccctgcccaactgttcctgctgtttctggtacagcaacatactcagtagtaagacccaatgcacctgattcaatatcatgttcttgagcacgaacagatacgcttgaagcagtaaagccataagcagctacttgttcttctcgtgtgaacacaagattgttatcagatacaaactggtcactaatagttgcaccggacgttacatgcatatttcgaatacgaacatcacgtcccccaacagaaggcttatcccacataatcttaatattagagttacctgggtcaccggtgaacactgcatacaatccagtaacaggattcattggattagcaggctgctctgcttgaccagtaacttgagcaccaatggatactaatccattacttgggtcatactccgataccatgaagatgacatgagtagcaccaccttctgccaaaccgtagaactcgttctgttctgcaacagtccatgttagagattcactcgaccattccttagaaaaaataacagtcttcgaatcgttaacactgatattcactacccagaagtgttgccatgttggacggcctacccaggtgaaaataatgtcaccattaagctgtttagcagctttcagttgagtaggtgtttgcatataggagccattctggactactcccacaaaggaagaagatgcacctactgcaccggaatcagcagcatactcagaaacagaaaaactcatattaagagtatccccgttataagcattttgctggtcattcaaggtaaacacatactcaggactggtaaggataccagaagagatttctacccctgtggtgacatgacggttggcgtatttccagtgggtaatcccagcacggttatcccatgtcatcttaatatcacgagtagctaacttacgaccttgcagatttgctggtgggcgtaagtaagaccaatcaggtggattagtagcacggttaatattaagagccagtgcttcacctaactcaatggctgtggcatggaatgcttctaccgtgtaataaatccaactggattccacattacggtaagcagtgtacaggttagaaccaggaacaaaggaacctagtttaaagcctatattagctgtagccatctgaatctgtttatcacgtacagtaacagtagcttcagagttaaggtcattaggtggagcaacaccaaaccaaacagtagtagccccttggaaccaaatctccagattagggttaccccagttggttctcatccatgcaagcattgctttgttggatgattcaaaagcagtcattaaagcaggccatgtagaagaattaacatccttcatatacatggtttcccacggattagcttcaatgaagtaatcaggtttaacacccaaacctttaaccatattgttaatagccagtaatgcatcacctggggaattactggaagtattccaccatttgtgagtacctaccgtcatacctgcactatcagcagctacgttaataggcattacctgaataggacgtaatccagctttctctgcaaaagtcagacgtagcgtagaagcagatactttgtctttacggccaattgcaccattagctgtggtagcagttgggtcagacatatcagtaaagtgtccaccaccaaactggttaatacctaccagaatggtcttcttaacaagccctgcattatccaaaggaatgttatctgaccaaggtgctgaaggaatttccttttcctggtacagacaaactactctccacttcatgaactcccacggattaggagaaccaaccgcttccatcattacaggaatccagtcttctacagtgaagtcagcatatacataaccatttgcttcttgagtacctgatactacaaatgagtgaagtatctggttcaaattagagggattatagatttcaatacgatactgagctaatgcagggtctaatccgtaagacttccaacggaactcaatatctccccatgtattacgacgggctgccaggaaagaaggtaaacctgtacgaataggtacgttaggttcatcagtgttagtgatgccccatgcataactcagttcctgaatgaaaataggaacctgtccatacagaccacgaagatactcaaataccttcttagtagcttgcttgattctggttaatgagggtgctgggtcacggtcacctgggtatgctaaagcagacgcatcctggtcaccttgcccccaaataatagctttaggcttgagcttacctacttgccctacacaatgtagtaatgcaggaccaggcttatctgcttctaaatcccaccaccaaagaccacctgcatcagatgattgagtagggtcaaatacttcagaattaggattaactgcacatgcacggtctacagcagttgagccagttgtcccattaatagggcgtacacctgcatagttaatgccccaagtttctgtcatgtatttctggaatgcatcatagccacggtcagggtatgcaccagacatgaagtgaatggcaacctgagattcaccagcaaacaggattgggtaatccagtacagtctgctcagtgattaactcaccagtctctttatcctgaaatgcagtaagacccttccagtagtgggacataccaatataagtagtccaccagtcacgataacctaagccataagccatctttacctgacgctcaggagtaaggttataaccatcatcaaagcctgaagtcatacccatacccatcactacttgagggtatttacgttgacccagttgcttacgaccggaaccagatacagtaaggttagtaaaccatttaacagaatctacttgtttaataggaccatctgtctgtaagtatttaccatagaatgcatcacatcctatgaacttacctgggagcatacctttgcatttaacagagaagttagaagtaccaaagccttcataacttactacttcgaactcattttctgctacctgagcattaccattaacatccaagtatctccagatacattggagtttatccccagcagctaaagcagcattagtatgaatacccccaatttccatctggaaagtaacaccatcatcattgttatacatggcagcaatgtatgcatctttccctaggccatgatgtgcttcagtacagtcaaaagaaatcattgtgatattacgaggattgatagttaccccgttaaatgccacacctgtacgtaaatcagcaaagtccagaatgaagatatagtccttagtgccatagacttctgtcatttcagattcaggaatgtcttcatcagtagctacaaagatgtcagcctgatacgttctcttggttccatactttgtatccaaacactcccatcgacgggttttattattgaatccatatggagccagacgatacgtatacgccttttcaggagtctgaatagtaactgtgaacttatctggttcgtcaggattatgacgaaaagccagaatcagacctaagtaattagggtttgtttcataacgatacagatgatggtcaaaggtatcttccgtcatccaacggacacctaagaagtctttgttagtacgccactgacaaggaactttaaaagacttagaaccatatggaatgatggtggctaccattaaggcattgtaatcaactacccaatactcagggtcaaaacgatttagtttagtgttataagttcgattacgacgagtgttgaccaacgtcagatgttctctgtctttcttaaattgaggaaggtcttctctccaagaagagtgctggtcatctgggtcataattaggagaagctaggcaattcttgcctttgagataatcttcaatggacataaccactccagtaataaggccggtttcccggcctagtttctttaagcgttggagttaataccaacaacggaaataccttccgtggtgttaaattcactgaacttaacctgaacacgaccgacatctacgattagagaaccataaggtactttatagattccgtgcataccacgagagtacatgatacccataccttccaatggggcatcaagtaaagaaccatctggtttagcaatcttcaatacaaaggagctatcagtatgactcttcagttgtgccgtaagctgagtaccatcggtaggtaacagtaagctaaatgtaacagtagaatctttgataagagtactgtgatataccgttaactcaccagatgccgtatcgaatgcacaataagtacccgaatcccaatcagatacagcagcccagccaccacctgaatatttcagttgtgcttctgcctcaccaaccataaccagtacagcagcccctgccgtaacactggagaatcgtggggtcagcggagccttacctgtaggggtaatgaaagtcatcactggttctacagtctgaagactaggtggatacccaagagtgatgccaccatatgcatctacattcagagtcactgcactggaaggcatgatacgggtattcacaccggagattgctttagcagttaggtctgctttaaaacgaagtggggcagtaacagatacagtagctgtattgtcagcagtagatgcacccataatcaggccatccaatgccatttgttgactaggtgctaccaacaaaccactaactttaccggctttataattaagaaccaggttagctactgcaccagcagtaggggcattcatgttgatggaaccagtagctagtgaccacaccccacgagcagaagtcagtttacctgctacagcataaccacctttgtcattacccatagtaataacctgacggagcattgcacctactgtattagctgcataagtctgtgcctgattaaagccaatcagacctgcaccttcagcagtagcatacttttcatggtcagcaatgattgcatcaagtcgctctgcaatggtaactaagtcacctaacctggcatgtacagccagtagttcagtcatgtgattatccaaatcaagcagtgctgccatattggtattcacattcttaatcgcattgatattagtacttactgtattaacagcatcaatggaaccagcaacggtattcacattggtaatgttattagcaacagtaattactttatcaatttgagcagaaacaataattaccttagcaatatcagttgctactgtattaactacatcaatgttagaagctacagtattgattggggtcaggttgtcatagaccctcagcaatgcctgaagattgtcatatagaccagtcagtttagataattgattgtagagttcgtgtaacttatccagattattatggataagctgtagttcatccagcttagtgtagatagcagatagctcagttaacttgttatggatagcaagtagctgagtcatattatcactgacagttttaataaaaggcattcgtaatgctacgaacttaacaacgtagtaagcattaccaatcatcttatcaacgattgggtcattaagtgtctcgcagcaatagccttcattggggatagtattaaacggggtatgaccgctcatcgccagcctctctttctgaacaaggtattcgtatcaacttctgtatcactaatgaggtcatactcaacaacctctctacagatgctgtcataaaaagacagatactctgctgcctttgctgaactctccggagtattcagagaagtgtaataacggtaagcaatgtaggcatccaaagctgggtcaagggtatcaggaatgtctatctcattatagccatcctctgctgtagacagtttaggatgtttagcctgatacattacgttcagtacttcccatgcttttggagcattgttctgtagaacgtttggccttggggtgaacaaactgtgagggttattacggtcattcaataggcgtctacgacctttatcgtcatacacttccaaaatacgaataacatcctcagcaaacttctcacctgctaagtccataatgaagggacacttcacttcatttgggtcataagactgaacagcatacttagctagtaatgggtagttggttctaccttcttgcatttcaacaaccacgttgttgttacgcatgttgaagcgaccatgcagacgagtcagtgcctcattagcagctacgataatgaaaggcttactatcatcttcaatgtcacctctgtcatctgtaacgatacctgtattgttcagcacaccattagccagacgacagaataactcttctatatagtacataagtcctcacacgatatatgaagagagtgggttaacacttccagtatcatcaccatcatcccacaatgggtcacctgatgtattaactggaaccatacctgcttgtggtttccacgggttcaggtagccaagcattgaaatggtatcaatacagtcatccttacctttaagaccattgatagtggctaaacgaatttgccccataaagagtgtcatgattgggctatctttcatctcagcaggaaaatacatcttaccagctttgaaccagggaaccacgaggttaaaccttgatagcttactggttacaggatgaataccaggttggcctccacgactggatgcaaagttaaagaatacattacggttaagcatttccttttgaagaagagaaataaaaccaccttgctgtccagtagtttctacaccaacttgttgtggttggtattcctgaaccagacggaataaatcatcaaagttcttatccatagtttgacggcaagcaataccatctacccagaaccagtcaccattagaaccatatgcccatactgatattacagagtagtcagatacctgcttctcactggtagcaaagtcagtagtgatatagaagttataacaagaacggagacgtaatagctgtgtacgggaataccatttaatctctgaatcctgaatcaaacgttcatcttcagaactgatacgtaacatcaattcctgataaaaggatgccagcttacctgtcttcaatgccatctggtattggtcattgatgtagtcataggagaaacggtcttcccaagcaccttgaaattcttctcgcgtacacgggaatttctcacatacaggccatacgttgacatcccaagcaccggattcaactgcttcaataagaatatcttccttattaaagggagtaccattaaagattaccttacgtcttgttgggtcaagagcatggttcacacctttatatactgtgtctttaatggcttccattgatgtacgtgagcgagcatcatcatcgctaactaagtcatctagtacacaaagaacggggcgtttaccaaaaatcttagtaccacgaagacccgtcttagcaccaaacatcttcacaccaagacggtgaccttcagcatttacaaactcaagatagttatctgtgaaggtagctttaggaatccattgttgtaggaatggcgaattgttgtatcggaactcaatgttcttacgggcagacttaacaccgttatccatagagtcagatacataaatcattccttccactttacccaagctaggtaggtgaccaaacactgctaagaacaacgtaaagtattccatgaacagagttgtctttgctgcaccacgaaaacataagttagcaatgtactgattcttactggttatcttatccagcatctttaagtgaacaggaggggttttgtttgattccccctccttaccattaaccagcttaataaagttagcaatggtcagtgcaaactcggttggtatatacgtaggggtattcagaacggaatagtccacttggtctagccattcatccaactcctgtttaattagttcagacatcaacaatatcctcgtcttctcgaaccagtgtggaacctgcaattactttagtaggtgtacctgcttcaatagctgctttctgagcttcagccaactgggtcagtgtgttcttaagttcggtcaatccagaattttctctcaaatccaggttgatattagtaacagcatccttcggtttttgaaggtgagtaaggatagagttagcagcatcacactgtaccttctcactggtagcatttttcatgagccatgcctgatggttcaatgcttcctgaaacaaatcctgattaacaatccatactggaatcagtgattgttccataatgaggtttactaacttacctctatggtaagcagacacataagcagagatgtccttctcactggttcctcttgctactagttcagcttgtctgttggggaatgttttgaagtaagcatctttgttgctataccccatatgtttgtaagtaacatattgaacagcattaaggtaatcctgggtcttaaacttcccatccttcatcaccccagcataagtcacaaagttatttctaatttgttctgctgctgtctggtcttgggtcacattgttaatcatgtttaccagtcggtcagtaacactgcttttaaactggggaggcaatgcagaaacaatgtctttcttagtcagtagtgtactcatagtcttcctacaaattatctagagtgaagaggattcttttcttggggttagcaccccttgcagaaacctatacatagatttagactttagactttctttagtctccttacaatagtaagacagagacatggggagcctattgcccaaaggaaccagtaacatgaggctattctatagttttgacggtaatgaccaatggaatgagatagacttcagtaaaataggtggagctatcccagttggaggggctatgccaggtgaccatatcttatgtcacgatgaggagtctttccattacatctcgggtatgatgttaatcaataacgtcactggatttactgtccataaacctgcaccagtacgtgtcattaccaagcctatcgagggtcttgcattctttacaagaatacctcaaagtatctctatcaaacgacagcgtgacgccatcgagatgaccgtggttgcttgataagccattgcccgcccaggagttggtggcgggaaacagggaactgtttgaataaccacttcagctacattcacctatctccaagacacctttgttatctgccattgggtgatgagtagtatcagagagaactgatttaacaaacacactcggcataggaattgggagccaaatggctcccttttcttttatgaaccaaggagttctatatgaacattcgtcctaatgaagtctatggtatcaacctagaatacactacaaacaaacctgctctatttcactgtggttccaccaatttattccatgctatgcgtggtaataccaaacctctttacttacccgaatcggatgatacccatgctctactaggtaactggttcttagaaggtaaagacattagtaccattcttcttgaaccaaggaagaaagtggcaatacctactaatgcatggaataacgaagtcatttacttcctagcaccaaaaggctttgaaccagtgatagaacagaatcactttaatcatgcagttactttctacttcagagagacttcaaagttatctgcttataaataaggaaagctatgtggtatataacagttaaaggtttatccgaaccagtgatgatagatagcctggccttcgtagaagtaggtcatcctattcttatagaaggtaagttgtatgaagttgttagtatttataagagataaataggaagtctattagatagataccctataattttttcttagtgaaaatagtcatagttacttgtgagttcagtatt

The invention claimed is:

1. A method of treating of an infection in a mammal in need thereof, comprising administering to the mammal infected with an *Escherichia coli* (*E. coli*) strain an antibacterial composition in an amount effective to treat said *E. coli* infection, wherein said composition comprises at least two distinct bacteriophages having lytic activity to said *E. coli* strain, said at least two distinct bacteriophages being selected from the bacteriophages having a genome comprising a nucleotide sequence selected from any one of SEQ ID NOs: 1 to 15 or a sequence having at least 99% identity thereto.

2. The method of claim 1, wherein the composition comprises at least three distinct bacteriophages selected from the bacteriophages having a genome comprising a nucleotide sequence selected from any one of SEQ ID NOs: 1 to 15 or a sequence having at least 99% identity thereto.

3. The method of claim 1, wherein the composition comprises a combination of all of the bacteriophages BP539, BP700, BP753, BP814, BP953, BP954, BP970, BP1002, BP1151, BP1155, BP1168, BP1176, BP1197, BP1226 and BP1229 comprising the nucleotide sequence of SEQ ID NOs: 1 to 15, respectively.

4. The method of claim 1, wherein the composition is lytic against antibiotic-resistant *E. coli* strains.

5. The method of claim 1, wherein the composition is lytic against more than 90% of all bacterial strains of EcoR collection.

6. The method of claim 1, wherein the composition further comprises a pharmaceutically acceptable excipient or carrier.

7. The method of claim 1, wherein the composition is a liquid, semi-liquid, solid or lyophilized formulation.

8. The method of claim 1, wherein the composition comprises between $10^{e2}$ and $10^{e12}$ PFU of bacteriophage.

9. A method for improving the condition of a mammal by modifying the microbial flora, comprising administering to the mammal an effective amount of an antibacterial composition, wherein said composition comprises at least two distinct bacteriophages having lytic activity to an *Escherichia coli* (*E. coli*) strain, said at least two distinct bacteriophages being selected from the bacteriophages having a genome comprising a nucleotide sequence selected from any one of SEQ ID NOs: 1 to 15 or a sequence having at least 99% identity thereto and said microbial flora comprises said *E. coli* strain.

10. A method for decontaminating a material, comprising exposing the material to an amount of an antibacterial composition effective to decontaminate said material, wherein said composition comprises at least two distinct bacteriophages having lytic activity to an *Escherichia coli* (*E. coli*) strain, said at least two distinct bacteriophages being selected from the bacteriophages having a genome comprising a nucleotide sequence selected from any one of SEQ ID NOs: 1 to 15 or a sequence having at least 99% identity thereto.

11. An antibacterial composition comprising at least two distinct bacteriophages having lytic activity to an *Escherichia coli* (*E. coli*) strain and a pharmaceutically acceptable excipient or carrier, said at least two distinct bacteriophages being selected from the bacteriophages having a genome comprising a nucleotide sequence selected from any one of SEQ ID NOs: 1 to 15 or a sequence having at least 99% identity thereto and said pharmaceutically acceptable excipient or carrier comprising a preservative in an amount effective to preserve the activity of the bacteriophages.

12. The composition of claim 11, comprising at least three distinct bacteriophages selected from the bacteriophages having a genome comprising a nucleotide sequence selected from any one of SEQ ID NOs: 1 to 15 or a sequence having at least 99% identity thereto.

13. The composition of claim 11, comprising a combination of all 15 of said bacteriophages.

14. The composition of claim 11, which is a liquid, semi-liquid, solid or lyophilized formulation.

* * * * *

UNITED STATES PATENT AND TRADEMARK OFFICE
CERTIFICATE OF CORRECTION

PATENT NO. : 10,918,680 B2
APPLICATION NO. : 15/110769
DATED : February 16, 2021
INVENTOR(S) : Flavie Pouillot and Hélène Blois Page 1 of 1

It is certified that error appears in the above-identified patent and that said Letters Patent is hereby corrected as shown below:

In the Specification

Column 9,
Line 56, "*ashuriae*," should read --*asburiae*,--.

Column 22,
Line 67, "VAT)," should read --V/V),--.

Column 24,
Line 61, "$7.89^{E+08}$" should read --$1.89^{E+08}$--.

Signed and Sealed this
Twenty-sixth Day of October, 2021

Drew Hirshfeld
*Performing the Functions and Duties of the
Under Secretary of Commerce for Intellectual Property and
Director of the United States Patent and Trademark Office*